US009631193B2

(12) United States Patent
Bettencourt et al.

(10) Patent No.: US 9,631,193 B2
(45) Date of Patent: *Apr. 25, 2017

(54) COMPOSITIONS AND METHODS FOR INHIBITING EXPRESSION OF THE ALAS1 GENE

(71) Applicants: ALNYLAM PHARMACEUTICALS, INC., Cambridge, MA (US); ICAHN SCHOOL OF MEDICINE AT MOUNT SINAI, New York, NY (US)

(72) Inventors: Brian Bettencourt, Groton, MA (US); Kevin Fitzgerald, Brookline, MA (US); William Querbes, Cambridge, MA (US); Makiko Yasuda, New York, NY (US); Robert J. Desnick, New York, NY (US)

(73) Assignees: ALNYLAM PHARMACEUTICALS, INC., Cambridge, MA (US); ICAHN SCHOOL OF MEDICINE AT MOUNT SINAI, New York, NY (US)

( * ) Notice: Subject to any disclaimer, the term of this patent is extended or adjusted under 35 U.S.C. 154(b) by 0 days.

This patent is subject to a terminal disclaimer.

(21) Appl. No.: 14/391,392

(22) PCT Filed: Apr. 10, 2013

(86) PCT No.: PCT/US2013/036006
§ 371 (c)(1),
(2) Date: Oct. 9, 2014

(87) PCT Pub. No.: WO2013/155204
PCT Pub. Date: Oct. 17, 2013

(65) Prior Publication Data
US 2015/0111841 A1   Apr. 23, 2015

Related U.S. Application Data

(63) Continuation-in-part of application No. 13/835,613, filed on Mar. 15, 2013, now Pat. No. 9,133,461.

(60) Provisional application No. 61/622,288, filed on Apr. 10, 2012.

(51) Int. Cl.
*C12N 1/21* (2006.01)
*C12N 15/113* (2010.01)
*A61K 31/713* (2006.01)

(52) U.S. Cl.
CPC .......... *C12N 15/113* (2013.01); *A61K 31/713* (2013.01); *C12N 15/1137* (2013.01); *C12N 2310/14* (2013.01); *C12N 2310/315* (2013.01); *C12N 2310/321* (2013.01); *C12N 2310/322* (2013.01); *C12N 2310/343* (2013.01); *C12N 2310/344* (2013.01); *C12N 2310/351* (2013.01); *C12N 2310/50* (2013.01); *C12N* *2310/533* (2013.01); *C12N 2320/30* (2013.01); *C12Y 203/01037* (2013.01)

(58) Field of Classification Search
USPC .... 435/6.1, 91.1, 91.31, 455, 458, 375, 325, 435/366; 514/44; 536/23.1, 24.5
See application file for complete search history.

(56) References Cited

U.S. PATENT DOCUMENTS

| 8,090,542 B2 * | 1/2012 | Khvorova ............ A61K 31/713 435/6.1 |
| 9,133,461 B2 * | 9/2015 | Bettencourt ......... A61K 31/713 |
| 2011/0054005 A1 | 3/2011 | Naito et al. |
| 2013/0178512 A1 * | 7/2013 | Manoharan ...... A61K 47/48092 514/44 A |
| 2013/0281511 A1 | 10/2013 | Bettencourt et al. |
| 2016/0115476 A1 | 4/2016 | Bettencourt et al. |
| 2016/0244766 A1 | 8/2016 | Bettencourt et al. |

FOREIGN PATENT DOCUMENTS

| EP | 1752536 A1 | 2/2007 |
| EP | 2213738 A2 | 8/2010 |
| WO | 2005116204 A1 | 12/2005 |
| WO | 2007131274 A1 | 11/2007 |
| WO | 2009073809 A2 | 6/2009 |
| WO | 2009134487 A2 | 11/2009 |
| WO | 2010148013 A2 | 12/2010 |
| WO | 2012177906 A1 | 12/2012 |
| WO | 2013074974 A2 | 5/2013 |
| WO | 2013155204 A2 | 10/2013 |
| WO | 2015051318 A1 | 4/2015 |

OTHER PUBLICATIONS

Schuurmans et al, Hepatology, vol. 33, No. 5, pp. 1217-1222 (2001).*
ALAS1 Pre-Design Chimera RNAi, www.abnova.com, XP002701598, Jan. 22, 2010.
Balwani and Desnick, "The Porphyrias: Advances in Diagnosis and Treatment," Blood, 120(23):4496-4504 (2012).
Bishop, D.F., et al., "Uroporphyrinogen III Synthase Knock-In Mice Have the Human Congenital Erythropoietic Pehnotype, Including the Characteristic Light-Induced Cutaneous Lesions," The American Journal of Human Genetids, 78:645-658 (2006).
Dar, F.S., et al. "Liver Transplantation of Acute Intermittent Porphyria: A Viable Treatment?", Hepatobiliary Pancreat. Dis. Int., 9(1):93-96 (2010).
Estall, J.L., et al., "PGC-1 Negatively Regulates Hepatic FGF21 Expression by Modulating the Heme/Rev-Erb Axis," Proceedings of the National Academy of Sciences, 106(52):22510-22515 (2009).
Floderus, Y., et al., "Variations in Prophobilinogen and 5-Aminolevulinic Acid Concentrations in Plasma and Urine from Asymptomatic Carriers of the Acute Intermittent Porphyria Gene with Increased Prophyrin Precursor Excretion," Clinical Chemistry, 52(4):701-707 (2006).

(Continued)

*Primary Examiner* — Jane Zara
(74) *Attorney, Agent, or Firm* — Lando & Anastasi, LLP

(57) ABSTRACT

The invention relates to double-stranded ribonucleic acid (dsRNA) compositions targeting the ALAS1 gene, and methods of using such dsRNA compositions to alter (e.g., inhibit) expression of ALAS1.

45 Claims, 18 Drawing Sheets

(56) References Cited

OTHER PUBLICATIONS

Hift, R.J., et al., "Drugs in Prophyria: From Observation of a Modern Algorithm-Based System for the Prediction of Porphyrogenicity," Pharmacology and Therapeutics, 132(2):158-169 (2011).

Hrdinka, M., et al., "May 2006 Update in Porphobilinogen Deaminase Gene Polymorphisms and Mutations Causing Acute Intermittent Porphyria. Comparison with the Situation in Slavic Population," Physiol. Res., 55 (Suppl. 2):S119-S136 (2006).

Invitation to Pay Additional Fees and Partial International Search Report, International Application No. PCT/US2013/036006, date of mailing Jul. 25, 2013.

Lin, CS-Y, et al., "Purple Pigments: The Pathophysiology of Acute Porphyric Neuropathy," Clinical Neurophysiology, 122:2336-2344 (2011).

Lindberg, R., et al., "Motor Neuropathy in Prophobilinogen Deaminase-Deficient Mice Imitates the Peripheral Neuropathy of Human Acute Porphyria," J. Clin. Invest., 103:1127-1134 (1999).

Lindberg, R., et al., "Porphobilinogen Deaminase Deficiency in Mice Causes a Neuropathy Resembling that of Human Hepatic Prophyria," Nature Genetics, 12:195-219 (1996).

Panhematin Product Label, pp. 1-7, revised (Oct. 2010).

Phillips, J.D., et al., "Functional Consequences of Naturally Occurring Mutations in Human Uroporphyrinogen Decarboxylase," Blood, 98:3179-3185 (2001).

Sardh, E., et al., "Safety, Pharmacokinetics and Pharmocodynamics of Recombinant Human Prophobilinogen Deaminase in Healthy Subjects and Asymptomatic Carriers of the Acute Intermittent Porphyria Gene Who Have Increased Prophyrin Precursor Excretion," Clin. Pharmacokinet. 46(4):335-349 (2007).

Schultz, N., et al., "Off-Target Effects Dominate a Large-Scale RNAi Screen for Modulators of the TGF-beta Pathway and Reveal MicroRNA Regulation of TGFBR2," Silence, 2:3, pp. 1-20 and Supplementary Table 1 (2011).

Schuurmans, M.M., et al., "Zinc Mesophorphyrin Represses Induced Hepatic 5-Aminolevulinic Acid Synthase and Reduces Heme Oxygenase Activity in a Mouse Model of Acute Hepatic Porphyria," Hepatology, 33(5):1217-1222.

Seth, A.K., et al., "Liver Transplantation for Prophyria: Who, When, and How?," Liver Transplantation, 13:1219-1227 (2007).

Thunell, S., et al., "Guide to Drug Porphyrogenicity Prediction and Drug Prescription in the Acute Porphyrias," British Journal of Clinical Pharmacology, 64(5):668-679 (2007).

Thunell, S., et al., "Prophyria in Sweden," Physiol. Res., 55 (Suppl 2):S109-S118 (2006).

Yasuda, M., et al., "AAV8-Mediated Gene Therapy Prevents Induced Biochemical Attacks of Acute Intermittent Porpyria and Improves Neuromotor Function," Molecular Therapy, 18(1):17-22 (2010).

Yasuda, M., et al., "Acute Intermittent Porphyria: A Severly Affected Knock-In Mouse that Mimics the Human Homozygous Dominant Phenotype," (Abstract of Presentation on Oct. 14, 2011 at the American Society of Human Genetics; Program No. 1308F; accessed online on Apr. 4, 2012 at ichg2011.org/cgi-bin/showdetail.pl?absno=21167).

Yin, L., et al., "Rev-erba, a Heme Sensor That Coordinates Metabolic and Circadian Pathways," Science, 318 (5857):1786-1789 and supporting online material (25 pages) (2007).

Zheng, J., et al., "Tissue-Specific Expression of ALA Synthase-1 and Heme Oxygenase-1 and Their Expression in Livers of Rats Chronically Exposed to Ethanol," FEBS Letters, 582(13):1829-1834 (2008).

International Search Report and Written Opinion for PCT/US2013/036006 mailed Nov. 18, 2013.

Sehgal, A. et al., "Quantitation of Tissue-specific Target Gene Modulation Using Circulating RNA," Poster presented at the Keystone Gene Silencing by small RNAs symposium (Vancouver, Feb. 7-12, 2012).

Sehgal, A. et al., "Tissue-specific gene silencing monitored in circulating RNA," RNA, 20:1-7 (2014; published online Dec. 19, 2013).

Crawford, R.I. et al., "Transient erythroporphyria of infancy," J. Am. Acad. Dermatol. 35 (5 pt 2) 833-834 (1996).

Floderus, Y. et al., "Acute intermittent porphyria in Sweden. Molecular, functional and clinical consequences of some new mutations found in the porphobilinogen deaminase gene," Clin. Genet. 62(4): 288-297 (2002).

Elder, G. et al., "The incidence of inherited porphyrias in Europe," J. Inherit. Metab. Dis. 36(5): 849-857 (2013).

Whatley et al, Acute Intermittent Porphyria. In: Pagon RA, Adam MP, Ardinger HH, et al., editors. GeneReviews [Internet], Seattle (WA): University of Washington, Seattle; 1993-2014.

Anderson, K.E., "Approaches to Treatment and Prevention of Human Porphyrias," in The Porphyrin Handbook: Medical Aspects of Porphyrins, edited by Karl M. Kadish, Kevin M. Smith, Roger Guilard (2003).

Wu, N. et al., "Negative feedback maintenance of heme homeostasis by its receptor, Rev-erba," Genes Dev. 23: 2201-2209 (2009).

Dowman, J.K. et al., "Liver Transplantation From Donors With Acute Intermittent Porphyria," Ann. Intern. Med. 154: 571-572 (2011).

Unzu, C. et al., "Sustained Enzymatic Correction by rAAV-Mediated Liver Gene Therapy Protects Against Induced Motor Neuropathy in Acute Porphyria Mice," Molecular Therapy 19(2): 243-250 (2011).

Alnylam Press Release dated Feb. 9, 2012 "Novel Method for Monitoring RNAi Activity in Blood Samples".

International Search Report and Written Opinion for PCT/US2014/059160 mailed Feb. 5, 2015.

Yao, X. et al., "Heme controls the regulation of protein tyrosine kinases Jak2 and Src", Biochemical and Biophysical Research Communications, Academic Press Inc., Orlando, FL, US, vol. 403, No. 1, pp. 30-35, Dec. 3, 2010.

Kumar, N. et al., "Regulation of Adipogenesis by Natural and Synthetic REV-ERB Ligands", Endocrinology, vol. 151, No. 7, pp. 3015-3025, Jul. 1, 2010.

Estall et al., "PGC-1 Negatively Regulates Hepatic FGF21 Expression by Modulating the Heme/Rev-Erb Axis", Proceedings of the National Academy of Sciences, vol. 106, No. 52, pp. 22510-22515, Dec. 29, 2009.

Yasuda et al., "RNAi-Mediated Silencing of Hepatic Alas1 Effectively Prevents and Treats the Induced Acute Attacks in Acute Intermittent Porphyria Mice", Proceedings of the National Academy of Sciences, vol. 111, No. 21, pp. 7777-7782, May 12, 2014.

Homedan et al., "Acute Intermittent Porphyria Causes Hepatic Mitochondrial Energetic Failure in a Mouse Model", International Journal of Biochemistry and Cell Biology, vol. 51, Apr. 13, 2014, pp. 93-101.

U.S. Appl. No. 13/835,613, filed Mar. 15, 2013.

\* cited by examiner

FIG. 2A

| Enzyme, Chromosomal location | Reaction Catalyzed | Associated Porphyria | Type of Porphyria | Typical Inheritance Pattern | Typical Symptoms |
|---|---|---|---|---|---|
| δ-aminolevulinate (ALA) synthase 1 <br><br> 3p21 | Glycine + SuccinylCoA <br> ↓ <br> δ-aminolevulinic acid (ALA) | | | | |
| δ-aminolevulinate (ALA) synthase 2 (ALAS2) (erythroid specific) <br><br> Xp11.21 | Glycine + SuccinylCoA <br> ↓ <br> δ-aminolevulinic acid (ALA) | X-linked sideroblastic anemia (XLSA), X-linked protoporphyria (XLP) | Erythropoietic | X-linked | |
| δ-aminolevulinate dehydratase (ALAD) <br><br> 9q34 | δ-aminolevulinic acid (ALA) <br> ↓ <br> Porphobilinogen (PBG) | ALA dehydratase deficiency porphyria (ADP or Doss porphyria) | Hepatic | Autosomal recessive | Abdominal pain, neuropathy |
| PBG deaminase (PBGD) or Hydroxymethylbilane synthase (HMBS) <br><br> 11q23 | Porphobilinogen (PBG) <br> ↓ <br> Hydroxymethylbilane (HMB) | Acute intermittent porphyria (AIP) | Hepatic | Autosomal dominant | Periodic abdominal pain, peripheral neuropathy, psychiatric disorders, tachycardia |

FIG. 2B

| Uroporphyrinogen III Synthase (UROS) 10q26 | Hydroxymethylbilane ↓ Uroporphyrinogen III (URO) | Congenital erythropoietic porphyria (CEP) | Erythropoietic | Autosomal recessive | Severe photosensitivity with erythema, swelling and blistering. Hemolytic anemia, splenomegaly |
|---|---|---|---|---|---|
| Uroporphyrinogen decarboxylase (UROD) 1q34 | Uroporphyrinogen III (URO) ↓ Coprophyrinogen III | Porphyria cutanea tarda (PCT) | Hepatic | Autosomal dominant or sporadic | Photosensitivity with vesicles and bullae |
| Coproporphyrinogen III oxidase (CPOX)3q12 | Coprophyrinogen III (COPRO) ↓ Protoporphyrinogen IX | Hereditary coproporphyria (HCP) | Hepatic | Autosomal dominant | Photosensitivity, neurologic symptoms, colic |
| Protoporphyrinogen oxidase (PPOX) 1q14 | Protoporphyrinogen IX (PROTO) ↓ Protoporphyrin IX | Variegate prophyria (VP) | Mixed | Autosomal dominant | Photosensitivity, neurologic symptoms, developmental delay |
| Ferrochelatase 18q21.3 | Protoporphyrin IX ↓ Heme | Erythropoietic protoporphyria (EPP) | Erythropoietic | Autosomal recessive | Photosensitivity with skin lesions. Gallstones, mild liver dysfunction |

FIG. 3A

```
   1 ctgtatatta aggcgccggc gatcgcggcc tgaggctgct cccggacaag ggcaacgagc
  61 gtttcgtttg gacttctcga cttgagtgcc cgcctccttc gccgccgcct ctgcagtcct
 121 cagcgcagtt atgcccagtt cttcccgctg tggggacacg accacggagg aatccttgct
 181 tcagggactc gggaccctgc tggacccctt cctcgggttt aggggatgtg gggaccagga
 241 gaaagtcagg atcctaaga gtcttccctg cctggatgga tgagtggctt cttctccacc
 301 tagattcttt ccacaggagc cagcatactt cctgaacatg gagagtgttg ttcgccgctg
 361 cccattctta tcccgagtcc cccaggcctt tctgcagaaa gcaggcaaat ctctgttgtt
 421 ctatgcccaa aactgcccca agatgatgga agttggggcc aagccagccc ctcgggcatt
 481 gtccactgca gcagtacact accaacagat caaagaaacc cctccggcca gtgagaaaga
 541 caaaactgct aaggccaagg tccaacgac tcctgatgga tccagcaga gtccagatgg
 601 cacacagctt ccgtctggac accccttgcc tgccacaagc cagggcactg caagcaaatg
 661 cccttcctg gcagcacaga tgaatcagag aggcagcagt gtcttctgca agccagtct
 721 tgagcttcag gaggatgtgc aggaaatgaa tgccgtgagg aaagaggttg ctgaaacctc
 781 agcaggcccc agtgtggtta gtgtgaaaac cgatggaggg gatcccagtg gactgctgaa
 841 gaacttccag gacatcatgc aaaagcaaag accagaaaga gtgtctcatc ttcttcaaga
 901 taacttgcca aaatctgttt ccacttttca gtatgatcgt ttctttgaga aaaaaattga
 961 tgagaaaaag aatgaccaca cctatcgagt ttttaaaact gtgaaccggc gagcacacat
1021 cttccccatg gcagatgact attcagactc cctcatcacc aaaaagcaag tgtcagtctg
1081 gtgcagtaat gactacctag gaatgagtcg ccacccacgg gtgtgtgggg cagttatgga
1141 cactttgaaa caacatggtg ctgggcagg tggtactaga aatatttctg gaactagtaa
1201 attccatgtg gacttagagc gggagctggc agacctccat gggaaagatg ccgcactctt
1261 gttttcctcg tgctttgtgg ccaatgactc aaccctcttc accctggcta agatgatgcc
1321 aggctgtgag atttactctg attctgggaa ccatgcctcc atgatccaag ggattcgaaa
1381 cagccgagtc ccaaagtaca tcttccgcca caatgatgtc agccacctca gagaactgct
1441 gcaaagatct gaccctcag tccccaagat tgtggcattt gaaactgtcc attcaatgga
1501 tggggcggtg tgcccactgg aagagctgtg tgatgtggcc catgagtttg gagcaatcac
1561 cttcgtggat gaggtccacg cagtggggct ttatggggct cgaggcggag ggattgggga
1621 tcgggatgga gtcatgccaa aaatggacat catttctgga acacttggca aagcctttgg
1681 ttgtgttgga gggtacatcg ccagcacgag ttctctgatt gacaccgtac ggtcctatgc
1741 tgctggcttc atcttcacca cctctctgcc acccatgctg ctggctggag ccctggagtc
1801 tgtgcggatc ctgaagagcg ctgagggacg ggtgcttcgc cgccagcacc agcgcaacgt
1861 caaactcatg agacagatgc taatggatgc cggcctccct gttgtccact gcccagcca
1921 catcatccct gtgcgggttg cagatgctgc taaaaacaca gaagtctgtg atgaactaat
1981 gagcagacat aacatctacg tgcaagcaat caattaccct acgtgcccc ggggagaaga
2041 gctcctacgg attgccccca cccctcacca cacaccccag atgatgaact acttccttga
2101 gaatctgcta gtcacatgga agcaagtggg gctggaactg aagcctcatt cctcagctga
2161 gtgcaacttc tgcaggaggc cactgcattt tgaagtgatg agtgaaagag agaagtccta
2221 tttctcaggc ttgagcaagt tggtatctgc tcaggcctga gcatgacctc aattatttca
```

FIG. 3B

```
2281 cttaacccca ggccattatc atatccagat ggtcttcaga gttgtcttta tatgtgaatt
2341 aagttatatt aaattttaat ctatagtaaa aacatagtcc tggaaataaa ttcttgctta
2401 aatggtg
     (SEQ ID NO:1)
```

FIG. 4A

```
   1 cagaagaagg cagcgcccaa ggcgcatgcg cagcggtcac tcccgctgta tattaaggcg
  61 ccggcgatcg cggcctgagg ctgctcccgg acaagggcaa cgagcgtttc gtttggactt
 121 ctcgacttga gtgcccgcct ccttcgccgc cgcctctgca gtcctcagcg cagttatgcc
 181 cagttcttcc cgctgtgggg acacgaccac ggaggaatcc ttgcttcagg gactcgggac
 241 cctgctggac cccttcctcg ggtttagggg atgtggggac caggagaaag tcaggatccc
 301 taagagtctt ccctgcctgg atggatgagt ggcttcttct ccacctagat tctttccaca
 361 ggagccagca tacttcctga acatggagag tgttgttcgc cgctgcccat tcttatcccg
 421 agtccccag gcctttctgc agaaagcagg caaatctctg ttgttctatg cccaaaactg
 481 ccccaagatg atggaagttg gggccaagcc agcccctcgg gcattgtcca ctgcagcagt
 541 acactaccaa cagatcaaag aaacccctcc ggccagtgag aaagacaaaa ctgctaaggc
 601 caaggtccaa cagactcctg atggatccca gcagagtcca gatggcacac agcttccgtc
 661 tggacacccc ttgcctgcca caagccaggg cactgcaagc aaatgcccc ttcctggcagc
 721 acagatgaat cagagaggca gcagtgtctt ctgcaaagcc agtcttgagc ttcaggagga
 781 tgtgcaggaa atgaatgccg tgaggaaaga ggttgctgaa acctcagcag gccccagtgt
 841 ggttagtgtg aaaaccgatg gagggatcc cagtggactg ctgaagaact tccaggacat
 901 catgcaaaag caaagaccag aaagagtgtc tcatcttctt caagataact gccaaaatc
 961 tgtttccact tttcagtatg atcgtttctt tgagaaaaaa attgatgaga aaagaatga
1021 ccacacctat cgagttttta aaactgtgaa ccggcgagca cacatcttcc ccatggcaga
1081 tgactattca gactccctca tcaccaaaaa gcaagtgtca gtctggtgca gtaatgacta
1141 cctaggaatg agtcgccacc cacgggtgtg tggggcagtt atggacactt tgaaacaaca
1201 tggtgctggg gcaggtggta ctagaaatat ttctggaact agtaaattcc atgtggactt
1261 agagcgggag ctggcagacc tccatgggaa agatgccgca ctcttgtttt cctcgtgctt
1321 tgtggccaat gactcaaccc tcttcaccct ggctaagatg atgccaggct gtgagattta
1381 ctctgattct gggaaccatg cctccatgat ccaagggatt cgaaacagcc gagtgccaaa
1441 gtacatcttc cgccacaatg atgtcagcca cctcagagaa ctgctgcaaa gatctgaccc
1501 ctcagtcccc aagattgtgg catttgaaac tgtccattca atggatgggg cggtgtgccc
1561 actggaagag ctgtgtgatg tgcccatga gtttggagca atcaccttcg tggatgaggt
1621 ccacgcagtg gggctttatg gggctcgagg cggagggatt ggggatcggg atggagtcat
1681 gccaaaaatg gacatcattt ctggaacact tggcaaagcc tttggttgtg ttggagggta
1741 catcgccagc acgagttctc tgattgacac cgtacggtcc tatgctgctg gcttcatctt
1801 caccacctct ctgccaccca tgctgctggc tggagccctg gagtctgtgc ggatcctgaa
1861 gagcgctgag ggacgggtgc ttcgccgcca gcaccagcgc aacgtcaaac tcatgagaca
1921 gatgctaatg gatgccggcc tccctgttgt ccactgcccc agccacatca tccctgtgcg
1981 ggttgcagat gctgctaaaa acacagaagt ctgtgatgaa ctaatgagca gacataacat
2041 ctacgtgcaa gcaatcaatt accctacggt gccccgggga gaagagctcc tacggattgc
2101 ccccaccct caccacacac cccagatgat gaactacttc cttgagaatc tgctagtcac
2161 atggaagcaa gtggggctgg aactgaagcc tcattcctca gctgagtgca acttctgcag
2221 gaggccactg catttgaag tgatgagtga agagagaag tcctatttct caggcttgag
```

FIG. 4B

```
2281 caagttggta tctgctcagg cctgagcatg acctcaatta tttcacttaa ccccaggcca
2341 ttatcatatc cagatggtct tcagagttgt ctttatatgt gaattaagtt atattaaatt
2401 ttaatctata gtaaaaacat agtcctggaa ataaattctt gcttaaatgg tgaaaaaa
     (SEQ ID NO:382)
```

FIG. 14
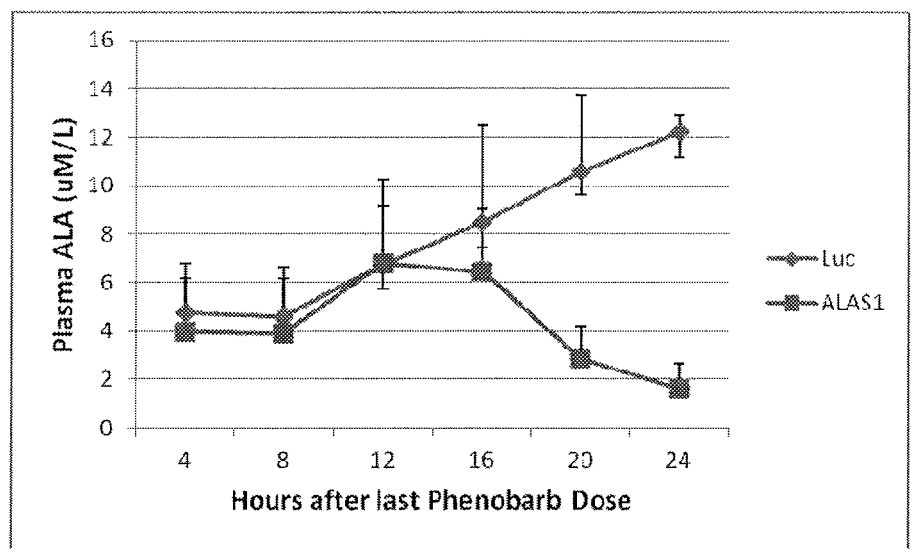
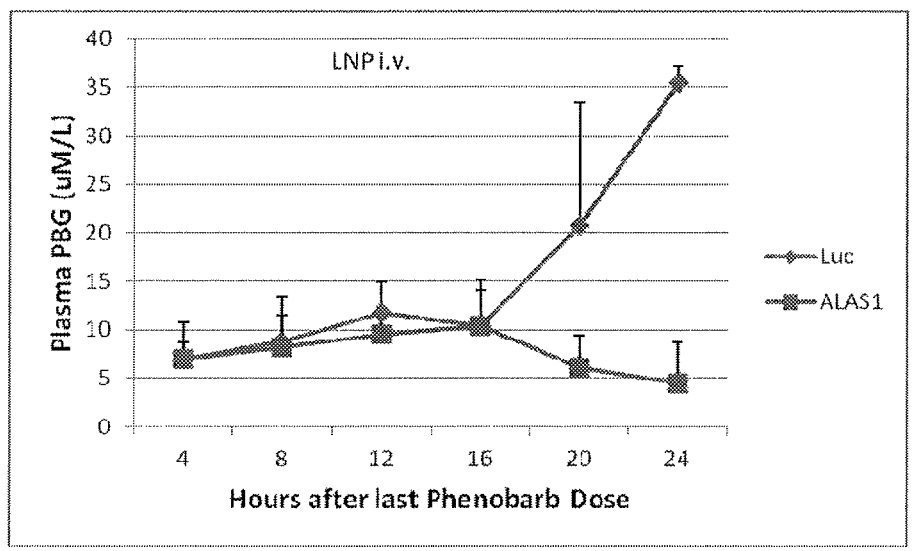

COMPOSITIONS AND METHODS FOR INHIBITING EXPRESSION OF THE ALAS1 GENE

RELATED APPLICATIONS

This application is national phase application under 35 U.S.C. §371 of International Application No. PCT/US2013036006, filed Apr. 10, 2013, which is a continuation-in-part of U.S. application Ser. No. 13/835,613, filed Mar. 15, 2013 and also claims priority to U.S. Provisional Application No. 61/622,288, filed Apr. 10, 2012. The entire content of each of the foregoing applications is hereby incorporated in its entirety.

FIELD OF THE INVENTION

The invention relates to the specific inhibition of the expression of the ALAS1 gene.

BACKGROUND OF THE INVENTION

The inherited porphyrias are a family of disorders resulting from the deficient activity of specific enzymes in the heme biosynthetic pathway, also referred to herein as the porphyrin pathway. Deficiency in the enzymes of the porphyrin pathway leads to insufficient heme production and to an accumulation of porphyrin precursors and porphyrins, which are toxic to tissue in high concentrations.

Of the inherited porphyrias, acute intermittent porphyria (AIP, e.g., autosomal dominant AIP), variegate porphyria (VP, e.g., autosomal dominant VP), hereditary coproporphyria (copropophyria or HCP, e.g., autosomal dominant HCP), and 5' aminolevulinic acid (also known as δ-aminolevulinic acid or ALA) dehydratase deficiency porphyria (ADP, e.g., autosomal recessive ADP) are classified as acute hepatic porphyrias and are manifested by acute neurological attacks that can be life threatening. The acute attacks are characterized by autonomic, peripheral, and central nervous symptoms, including severe abdominal pain, hypertension, tachycardias, constipation, motor weakness, paralysis, and seizures. If not treated properly, quadriplegia, respiratory impairment, and death may ensue. Various factors, including cytrochrome P450-inducing drugs, dieting, and hormonal changes can precipitate acute attacks by increasing the activity of hepatic 5'-aminolevulinic acid synthase 1 (ALAS1), the first and rate-limiting enzyme of the heme biosynthetic pathway. In the acute porphyrias, e.g., AIP, VP, HCP and ADP, the respective enzyme deficiencies result in hepatic production and accumulation of one or more substances (e.g., porphyrins and/or porphyrin precursors, e.g., ALA and/or PBG) that can be neurotoxic and can result in the occurrence of acute attacks. See, e.g., Balwani, M and Desnick, R. J., Blood, 120:4496-4504, 2012.

The current therapy for the acute neurologic attacks is the intravenous administration of hemin (Panhematin®, Lundbeck or Normosang®, Orphan Europe), which provides exogenous heme for the negative feedback inhibition of ALAS1, and thereby, decreases production of ALA and PBG. Hemin is used for the treatment during an acute attack and for prevention of attacks, particularly in women with the acute porphyrias who experience frequent attacks with the hormonal changes during their menstrual cycles. While patients generally respond well, its effect is slow, typically taking two to four days or longer to normalize urinary ALA and PBG concentrations towards normal levels. As the intravenous hemin is rapidly metabolized, three to four infusions are usually necessary to effectively treat or prevent an acute attack. In addition, repeated infusions may cause iron overload and phlebitis, which may compromise peripheral venous access. Although orthotrophic liver transplantation is curative, this procedure has significant morbidity and mortality and the availability of liver donors is limited. Therefore, an alternative therapeutic approach that is more effective, fast-acting, and safe is needed. It would be particularly advantageous if such treatment could be delivered by subcutaneous administration, as this would preclude the need for infusions and prolonged hospitalization.

AIP, also referred to as porphobilinogen deaminase (PBGD) deficiency, or hydroxymethylbilane synthase (HMBS) deficiency, is the most common of the acute hepatic prophyrias. It is an autosomal dominant disorder caused by mutations in the HMBS gene that result in reduced, e.g., half-normal activity of the enzyme. Previously, a mouse model of AIP that has ~30% of wildtype HMBS activity was generated by homologous recombination. Like human patients, these mice increase hepatic ALAS1 activity and accumulate large quantities of plasma and urinary ALA and PBG when administered porphyrinogenic drugs, such as phenobarbital. Thus, they serve as an excellent model to evaluate the efficacy of novel therapeutics for the acute hepatic porphyrias.

SUMMARY OF THE INVENTION

The present invention describes methods and iRNA compositions for modulating the expression of an ALAS1 gene. In certain embodiments, expression of an ALAS1 gene is reduced or inhibited using an ALAS1-specific iRNA. Such inhibition can be useful in treating disorders related to ALAS1 expression, such as porphyrias.

Accordingly, described herein are compositions and methods that effect the RNA-induced silencing complex (RISC)-mediated cleavage of RNA transcripts of the ALAS1 gene, such as in a cell or in a subject (e.g., in a mammal, such as a human subject). Also described are compositions and methods for treating a disorder related to expression of an ALAS1 gene, such as a porphyria, e.g., X-linked sideroblastic anemia (XLSA), ALA deyhdratase deficiency porphyria (Doss porphyria or ADP), acute intermittent porphyria (AIP), congenital erythropoietic porphyria (CEP), prophyria cutanea tarda (PCT), hereditary coproporphyria (coproporphyria, or HCP), variegate porphyria (VP), erythropoietic protoporphyria (EPP), or transient erythroporphyria of infancy. In some embodiments, the disorder is an acute hepatic porphyria, e.g., ALA deyhdratase deficiency porphyria (ADP), AIP, HCP, or VP. In certain embodiments, the disorder is ALA deyhdratase deficiency porphyria (ADP) or AIP.

In embodiments, the porphyria is a hepatic porphyria, e.g., a porphyria selected from acute intermittent porphyria (AIP) hereditary coproporphyria (HCP), variegate porphyria (VP), ALA deyhdratase deficiency porphyria (ADP), and hepatoerythropoietic porphyria. In embodiments, the porphyria is a homozygous dominant hepatic porphyria (e.g., homozygous dominant AIP, HCP, or VP) or hepatoerythropoietic porphyria, In embodiments, the porphyria is a dual porphyria.

As used herein, the term "iRNA," "RNAi", "iRNA agent," or "RNAi agent" refers to an agent that contains RNA as that term is defined herein, and which mediates the targeted cleavage of an RNA transcript, e.g., via an RNA-induced silencing complex (RISC) pathway. In one embodiment, an iRNA as described herein effects inhibition of ALAS1 expression in a cell or mammal.

The iRNAs included in the compositions featured herein encompass a dsRNA having an RNA strand (the antisense strand) having a region, e.g., a region that is 30 nucleotides or less, generally 19-24 nucleotides in length, that is substantially complementary to at least part of an mRNA transcript of an ALAS1 gene (e.g., a mouse or human ALAS1 gene) (also referred to herein as an "ALAS1-specific iRNA"). Alternatively, or in combination, iRNAs encompass a dsRNA having an RNA strand (the antisense strand) having a region that is 30 nucleotides or less, generally 19-24 nucleotides in length, that is substantially complementary to at least part of an mRNA transcript of an ALAS1 gene (e.g., a human variant 1 or 2 of an ALAS1 gene) (also referred to herein as a "ALAS1-specific iRNA").

In embodiments, the iRNA (e.g, dsRNA) described herein comprises an antisense strand having a region that is substantially complementary to a region of a human ALAS1. In embodiments, the human ALAS1 has the sequence of NM_000688.4 (SEQ ID NO:1) or NM_000688.5 (SEQ ID NO:382).

In other embodiments, an iRNA encompasses a dsRNA having an RNA strand (the antisense strand) having a region that is substantially complementary to a portion of an ALAS1 mRNA according to any one of Tables 2, 3, 6, 7, 8, 9, 14, 15, 18 or 20. In one embodiment, the iRNA encompasses a dsRNA having an RNA strand (the antisense strand) having a region that is substantially complementary to a portion of an ALAS1 mRNA, e.g., a human ALAS1 mRNA (e.g., a human ALAS1 mRNA as provided in SEQ ID NO:1 or SEQ ID NO:382).

In one embodiment, an iRNA for inhibiting expression of an ALAS1 gene includes at least two sequences that are complementary to each other. The iRNA includes a sense strand having a first sequence and an antisense strand having a second sequence. The antisense strand includes a nucleotide sequence that is substantially complementary to at least part of an mRNA encoding an ALAS1 transcript, and the region of complementarity is 30 nucleotides or less, and at least 15 nucleotides in length. Generally, the iRNA is 19 to 24 nucleotides in length.

In some embodiments, the iRNA is 19-21 nucleotides in length. In some embodiments, the iRNA is 19-21 nucleotides in length and is in a lipid formulation, e.g. a lipid nanoparticle (LNP) formulation (e.g., an LNP11 formulation).

In some embodiments, the iRNA is 21-23 nucleotides in length. In some embodiments, the iRNA is 21-23 nucleotides in length and is in the form of a conjugate, e.g., conjugated to one or more GalNAc derivatives as described herein.

In some embodiments the iRNA is from about 15 to about 25 nucleotides in length, and in other embodiments the iRNA is from about 25 to about 30 nucleotides in length. An iRNA targeting ALAS1, upon contact with a cell expressing ALAS1, inhibits the expression of an ALAS1 gene by at least 10%, at least 20%, at least 25%, at least 30%, at least 35% or at least 40% or more, such as when assayed by a method as described herein. In one embodiment, the iRNA targeting ALAS1 is formulated in a stable nucleic acid lipid particle (SNALP).

In one embodiment, an iRNA (e.g., a dsRNA) featured herein includes a first sequence of a dsRNA that is selected from the group consisting of the sense sequences of Tables 2, 3, 6, 7, 8, 9, 14, and 15 and a second sequence that is selected from the group consisting of the corresponding antisense sequences of Tables 2, 3, 6, 7, 8, 9, 14 and 15.

In one embodiment, an iRNA (e.g., a dsRNA) featured herein includes a first sequence of a dsRNA that is selected from the group consisting of the sense sequences of Tables 2, 3, 6, 7, 8, 9, 14, 15, 18 and 20 and a second sequence that is selected from the group consisting of the corresponding antisense sequences of Tables 2, 3, 6, 7, 8, 9, 14, 15, 18 and 20. In one embodiment, an iRNA (e.g., a dsRNA) featured herein has sense and/or antisense sequences selected from those of AD-58882, AD-58878, AD-58886, AD-58877, AD-59115, AD-58856, AD-59129, AD-59124, AD-58874, AD-59125, AD-59105, AD-59120, AD-59122, AD-59106, AD-59126, and AD-59107 as disclosed herein in the Examples. In embodiments, the iRNA (e.g., dsRNA) has sense and/or antisense sequences selected from those of AD-58882, AD-58878, AD-58886, AD-58877, AD-59115, AD-58856, and AD-59129.

The iRNA molecules featured herein can include naturally occurring nucleotides or can include at least one modified nucleotide, including, but not limited to a 2'-O-methyl modified nucleotide, a nucleotide having a 5'-phosphorothioate group, and a terminal nucleotide linked to a cholesteryl derivative. Alternatively, the modified nucleotide may be chosen from the group of: a 2'-deoxy-2'-fluoro modified nucleotide, a 2'-deoxy-modified nucleotide, a locked nucleotide, an abasic nucleotide, 2'-amino-modified nucleotide, 2'-alkyl-modified nucleotide, morpholino nucleotide, a phosphoramidate, and a non-natural base comprising nucleotide. Such a modified sequence can be based, e.g., on a first sequence of said iRNA selected from the group consisting of the sense sequences of Table 2, and a second sequence selected from the group consisting of the corresponding antisense sequences of Table 2.

In one embodiment, an iRNA (e.g., a dsRNA) featured herein comprises a sense strand comprising a sequence selected from the group consisting of SEQ ID NO:330, SEQ ID NO:334, SEQ ID NO:342, SEQ ID NO:344, SEQ ID NO:346, SEQ ID NO:356, SEQ ID NO:358, SEQ ID NO:362, SEQ ID NO:366, SEQ ID NO:376, and SEQ ID NO:380.

In one embodiment, an iRNA (e.g., a dsRNA) featured herein comprises an antisense strand comprising a sequence selected from the group consisting of SEQ ID NO:331, SEQ ID NO:335, SEQ ID NO:343, SEQ ID NO:345, SEQ ID NO:347, SEQ ID NO:357, SEQ ID NO:359, SEQ ID NO:363, SEQ ID NO:367, SEQ ID NO:377, and SEQ ID NO:381.

In one embodiment, an iRNA (e.g., a dsRNA) featured herein comprises a sense strand comprising a sequence selected from the group consisting of SEQ ID NO:140, SEQ ID NO:144, SEQ ID NO:152, SEQ ID NO:154, SEQ ID NO:156, SEQ ID NO:166, SEQ ID NO:168, SEQ ID NO:172, SEQ ID NO:176, SEQ ID NO:186, and SEQ ID NO:190. In one embodiment, an iRNA (e.g., a dsRNA) featured herein comprises an antisense strand comprising a sequence selected from the group consisting of SEQ ID NO:141, SEQ ID NO:145, SEQ ID NO:153, SEQ ID NO:155, SEQ ID NO:157, SEQ ID NO:167, SEQ ID NO:169, SEQ ID NO:173, SEQ ID NO:177, SEQ ID NO:187, and SEQ ID NO:191.

In one embodiment, an iRNA as described herein targets a wildtype ALAS1 RNA transcript variant, and in another embodiment, the iRNA targets a mutant transcript (e.g., an ALAS1 RNA carrying an allelic variant). For example, an iRNA featured in the invention can target a polymorphic variant, such as a single nucleotide polymorphism (SNP), of ALAS1. In another embodiment, the iRNA targets both a wildtype and a mutant ALAS1 transcript. In yet another embodiment, the iRNA targets a particular transcript variant of ALAS1 (e.g., human ALAS1 variant 1). In yet another embodiment, the iRNA agent targets multiple transcript variants (e.g., both variant 1 and variant 2 of human ALAS1).

In one embodiment, an iRNA featured in the invention targets a non-coding region of an ALAS1 RNA transcript, such as the 5' or 3' untranslated region of a transcript.

In some embodiments, an iRNA as described herein is in the form of a conjugate, e.g., a carbohydrate conjugate, which may serve as a targeting moiety and/or ligand, as described herein. In one embodiment, the conjugate is attached to the 3' end of the sense strand of the dsRNA. In some embodiments, the conjugate is attached via a linker, e.g., via a bivalent or trivalent branched linker.

In some embodiments, the conjugate comprises one or more N-acetylgalactosamine (GalNAc) derivatives. Such a conjugate is also referred to herein as a GalNAc conjugate. In some embodiments, the conjugate targets the RNAi agent to a particular cell, e.g., a liver cell, e.g., a hepatocyte. The GalNAc derivatives can be attached via a linker, e.g., a bivalent or trivalent branched linker. In particular embodiments, the conjugate is

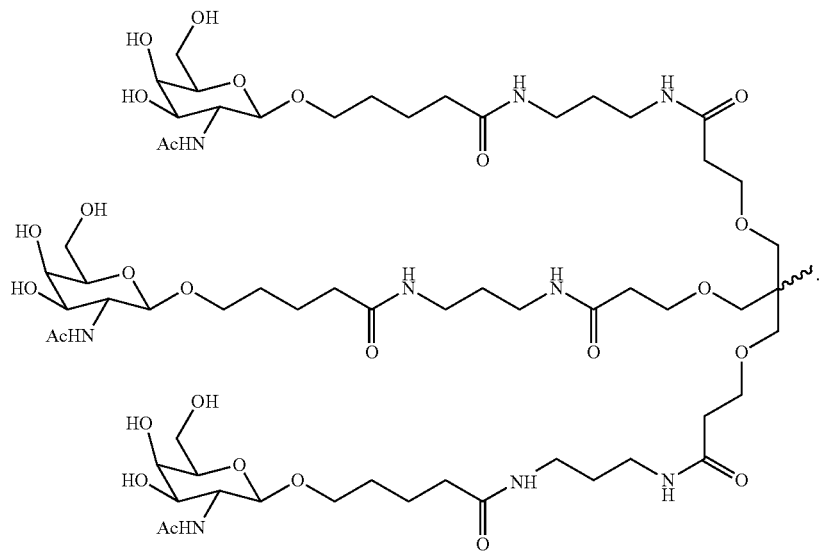 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

In some embodiments, the RNAi agent is attached to the carbohydrate conjugate via a linker, e.g., a linker as shown in the following schematic, wherein X is O or S

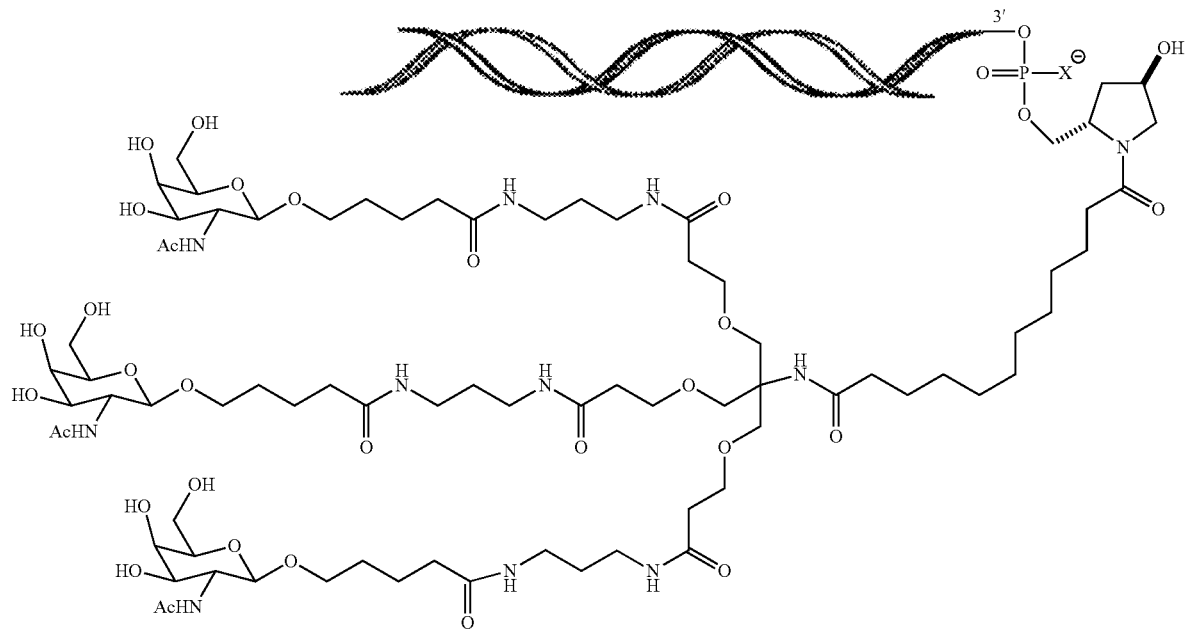

In some embodiments, X is O. In some embodiments, X is S.

In some embodiments, the RNAi agent is conjugated to L96 as defined in Table 1 and shown below

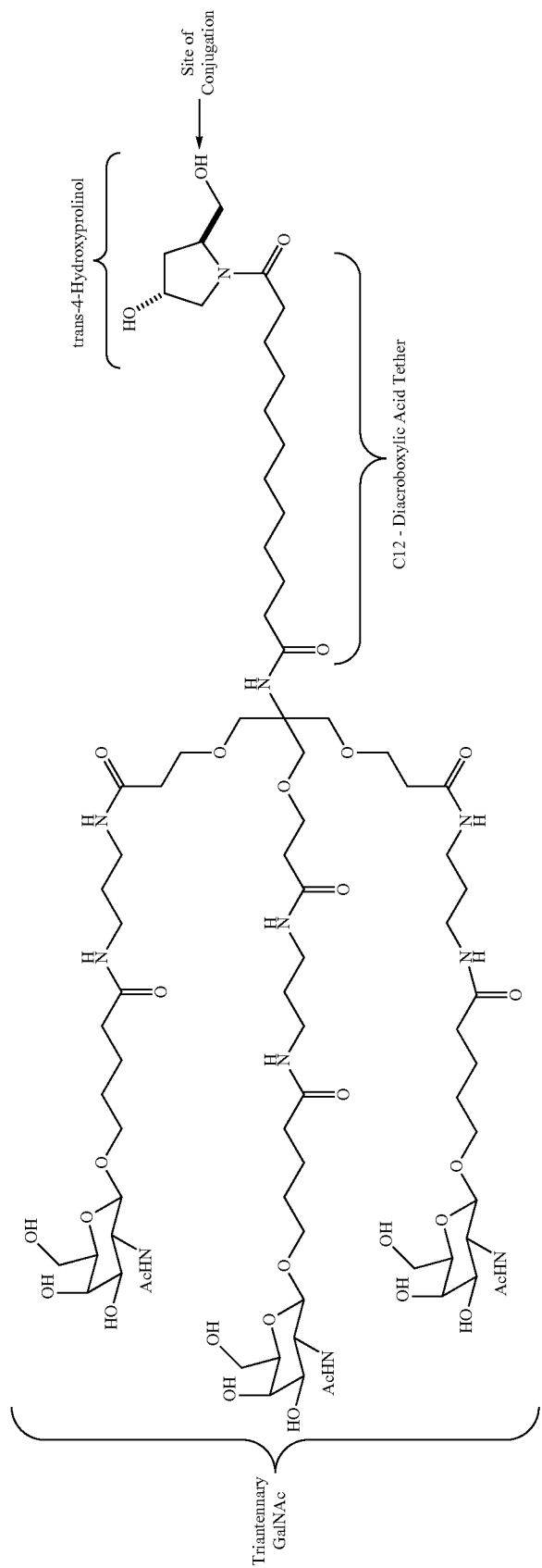

In an aspect provided herein is a pharmaceutical composition for inhibiting the expression of an ALAS1 gene in an organism, generally a human subject. The composition typically includes one or more of the iRNAs described herein and a pharmaceutically acceptable carrier or delivery vehicle. In one embodiment, the composition is used for treating a porphyria, e.g., AIP.

In one aspect, an iRNA provided herein is a double-stranded ribonucleic acid (dsRNA) for inhibiting expression of ALAS1, wherein said dsRNA comprises a sense strand and an antisense strand 15-30 base pairs in length and the antisense strand is complementary to at least 15 contiguous nucleotides of SEQ ID NO: 1 or 382.

In a further aspect, an iRNA provided herein is a double stranded RNAi (dsRNA) comprising a sense strand complementary to an antisense strand, wherein said antisense strand comprises a region of complementarity to an ALAS1 RNA transcript, wherein each strand has about 14 to about 30 nucleotides, wherein said double stranded RNAi agent is represented by formula (III):

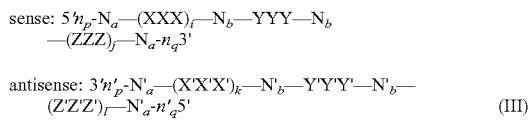

wherein:
j, k, and l are each independently 0 or 1;
p, p', q, and q' are each independently 0-6;
each $N_a$ and $N'_a$ independently represents an oligonucleotide sequence comprising 0-25 nucleotides which are either modified or unmodified or combinations thereof, each sequence comprising at least two differently modified nucleotides;
each $N_b$ and $N'_b$ independently represents an oligonucleotide sequence comprising 0-10 nucleotides which are either modified or unmodified or combinations thereof;
each $n_p$, $n'_p$, $n_q$, and $n'_q$ independently represents an overhang nucleotide;
XXX, YYY, ZZZ, X'X'X', Y'Y'Y', and Z'Z'Z' each independently represent one motif of three identical modifications on three consecutive nucleotides;
modifications on $N_b$ differ from the modification on Y and modifications on $N'_b$ differ from the modification on Y'.

In embodiments, the sense strand is conjugated to at least one ligand.

In embodiments, i is 1; j is 1; or both i and j are 1.
In embodiments, k is 1; l is 1; or both k and l are 1.
In embodiments, XXX is complementary to X'X'X', YYY is complementary to Y'Y'Y', and ZZZ is complementary to Z'Z'Z'.

In embodiments, the Y'Y'Y' motif occurs at the 11, 12 and 13 positions of the antisense strand from the 5'-end.

In embodiments, the Y' is 2'-O-methyl.
In embodiments, the duplex region is 15-30 nucleotide pairs in length.
In embodiments, the duplex region is 17-23 nucleotide pairs in length.
In embodiments, the duplex region is 19-21 nucleotide pairs in length.
In embodiments, the duplex region is 21-23 nucleotide pairs in length.
In embodiments, the modifications on the nucleotides are selected from the group consisting of LNA, HNA, CeNA, 2'-methoxyethyl, 2'-O-alkyl, 2'-O-allyl, 2'-C-allyl, 2'-fluoro, 2'-deoxy, 2'-hydroxyl, and combinations thereof.
In embodiments, the modifications on the nucleotides are 2'-O-methyl, 2'-fluoro or both.
In embodiments, the ligand comprises a carbohydrate.
In embodiments, the ligand is attached via a linker.
In embodiments, the linker is a bivalent or trivalent branched linker.
In embodiments, the ligand is

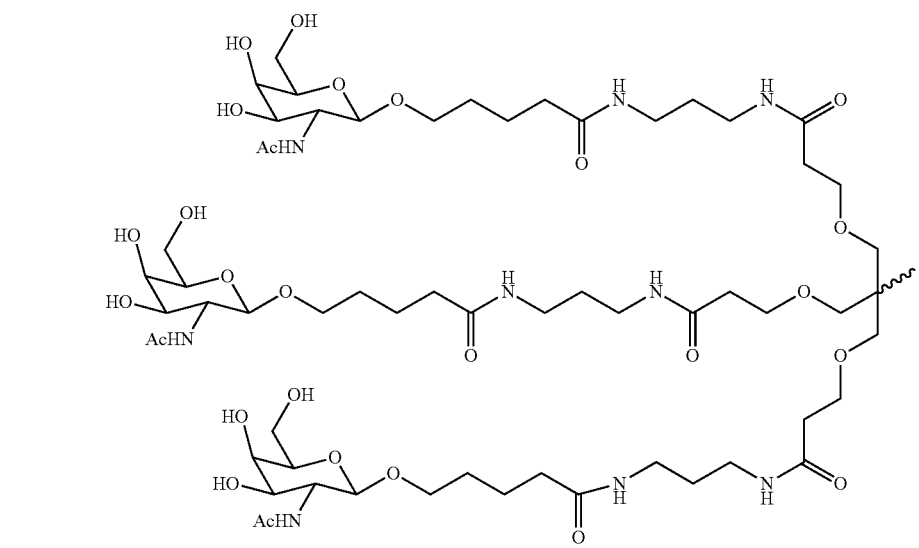

In embodiments, the ligand and linker are as shown in Formula XXIV:

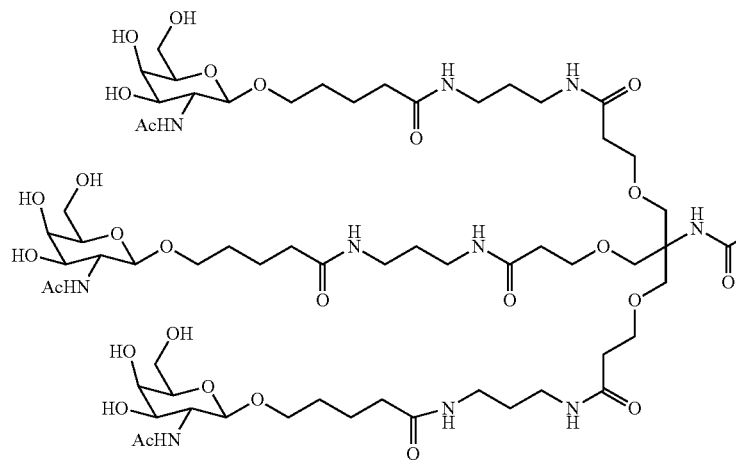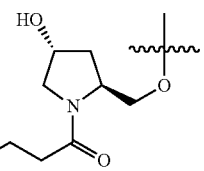

In embodiments, the ligand is attached to the 3' end of the sense strand.

In embodiments, the dsRNA has (e.g., comprises) a nucleotide sequence selected from the group of sequences provided in Tables 2 and 3. In embodiments, the dsRNA has a nucleotide sequence selected from the group of sequences provided in Tables 2, 3, 6, 7, 8 and 9. In embodiments, the dsRNA has a nucleotide sequence selected from the group of sequences provided in Tables 2, 3, 6, 7, 8, 9, 14, and 15. In embodiments, the dsRNA has a nucleotide sequence selected from the group of sequences provided in Tables 2, 3, 6, 7, 8, 9, 14, 15, 18 and 20. In embodiments, the dsRNA has a nucleotide sequence disclosed in Table 18. In embodiments, the dsRNA has a nucleotide sequence selected from the group of sequences provided in Tables 14 and 15.

In embodiments, dsRNA has a nucleotide sequence selected from the group of sequences provided in Tables 3 and 8.

In a further aspect, an iRNA provided herein is a double-stranded ribonucleic acid (dsRNA) for inhibiting expression of ALAS1, wherein said dsRNA comprises a sense strand and an antisense strand, the antisense strand comprising a region of complementarity to an ALAS1 RNA transcript, which antisense strand comprises at least 15 contiguous nucleotides differing by no more than 3 nucleotides from one of the antisense sequences listed in any one of Tables 2, 3, 6, 7, 8, 9, 14, 15, 18 or 20. In some such embodiments, the sense and antisense sequences are selected from those of the duplexes AD-58882, AD-58878, AD-58886, AD-58877, AD-59115, AD-58856, AD-59129, AD-59124, AD-58874, AD-59125, AD-59105, AD-59120, AD-59122, AD-59106, AD-59126, and AD-59107 as disclosed herein in the Examples. In embodiments, the sense and antisense sequences are selected from those of the duplexes AD-58882, AD-58878, AD-58886, AD-58877, AD-59115, AD-58856, and AD-59129. In embodiments, the sense and antisense sequences are those of the duplex AD-58632. In embodiments, the sense and antisense sequences are selected from those of the duplexes AD-59453, AD-59395, AD-59477, and AD-59492. In embodiments, the sense and antisense sequences are those of a duplex disclosed herein that suppresses ALAS1 mRNA expression by at least 50%, 60%, 70%, 80%, 85% or 90%, e.g., as assessed using an assay disclosed in the Examples provided herein.

In some embodiments, the dsRNA comprises at least one modified nucleotide.

In some embodiments, at least one of the modified nucleotides is chosen from the group consisting of: a 2'-O-methyl modified nucleotide, a nucleotide comprising a 5'-phosphorothioate group, and a terminal nucleotide linked to a cholesteryl derivative or dodecanoic acid bisdecylamide group.

In some embodiments, the modified nucleotide is chosen from the group consisting of: a 2'-deoxy-2'-fluoro modified nucleotide, a 2'-deoxy-modified nucleotide, a locked nucleotide, an abasic nucleotide, 2'-amino-modified nucleotide, 2'-alkyl-modified nucleotide, morpholino nucleotide, a phosphoramidate, and a non-natural base comprising nucleotide.

In some embodiments, the region of complementarity is at least 17 nucleotides in length.

In some embodiments, the region of complementarity is between 19 and 21 nucleotides in length.

In some embodiments, the region of complementarity is 19 nucleotides in length.

In some embodiments, each strand is no more than 30 nucleotides in length.

In some embodiments, at least one strand comprises a 3' overhang of at least 1 nucleotide.

In some embodiments, at least one strand comprises a 3' overhang of at least 2 nucleotides.

In some embodiments, a dsRNA described herein further comprises a ligand.

In some embodiments, the ligand is a GalNAc ligand.

In some embodiments, the ligand targets the dsRNA to hepatocytes.

In some embodiments, the ligand is conjugated to the 3' end of the sense strand of the dsRNA.

In some embodiments, the region of complementarity consists of an antisense sequence selected from Table 2 or Table 3. In embodiments, the region of complementarity consists of an antisense sequence selected from Tables 2, 3, 6, 7, 8, 9, 14, or 15. In embodiments, the region of complementarity consists of an antisense sequence selected from Tables 2, 3, 6, 7, 8, 9, 14, 15, 18, or 20. In some embodiments, the region of complementarity consists of an antisense sequence selected from that of AD-58882, AD-58878, AD-58886, AD-58877, AD-59115, AD-58856, AD-59129, AD-59124, AD-58874, AD-59125, AD-59105, AD-59120, AD-59122, AD-59106, AD-59126, or AD-59107 as disclosed herein in the Examples. In some embodiments, the region of complementarity consists of the antisense sequence of the duplex AD-58632. In embodiments, the region of complementarity consists of an antisense sequence selected from that of AD-59453, AD-59395, AD-59477, and AD-59492. In embodiments, the region of complementarity consists of an antisense sequence selected from a duplex disclosed herein that suppresses ALAS1 mRNA expression by at least 50%, 60%, 70%, 80%, 85% or 90%, e.g., as assessed using an assay disclosed in the Examples provided herein.

In some embodiments, the dsRNA comprises a sense strand consisting of a sense strand sequence selected from Table 2 or Table 3, and an antisense strand consisting of an antisense sequence selected from Table 2 or Table 3.

In some embodiments, the dsRNA comprises a sense strand consisting of a sense strand sequence selected from Tables 2, 3, 6, 7, 8, 9, 14, or 15, and an antisense strand consisting of an antisense sequence selected from Tables 2, 3, 6, 7, 8, 9, 14, or 15. In embodiments, the dsRNA comprises a pair of corresponding sense and antisense sequences selected from those of the duplexes disclosed in Tables 2, 3, 6, 7, 8, 9, 14, and 15.

In some embodiments, the dsRNA comprises a sense strand consisting of a sense strand sequence selected from Tables 2, 3, 6, 7, 8, 9, 14, 15, 18 or 20, and an antisense strand consisting of an antisense sequence selected from Tables 2, 3, 6, 7, 8, 9, 14, 15, 18 or 20. In embodiments, the dsRNA comprises a pair of corresponding sense and antisense sequences selected from those of the duplexes disclosed in Tables 2, 3, 6, 7, 8, 9, 14, 15, 18 and 20.

In one aspect, the invention provides a cell containing at least one of the iRNAs (e.g., dsRNAs) featured herein. The cell is generally a mammalian cell, such as a human cell. In some embodiments, the cell is an erythroid cell. In other embodiments, the cell is a liver cell (e.g., a hepatocyte).

In an aspect provided herein is a pharmaceutical composition for inhibiting expression of an ALAS1 gene, the composition comprising an iRNA (e.g., a dsRNA) described herein.

In embodiments of the pharmaceutical compositions described herein, the iRNA (e.g., dsRNA) is administered in an unbuffered solution. In embodiments, the unbuffered solution is saline or water.

In embodiments of the pharmaceutical compositions described herein, the iRNA (e.g., dsRNA is administered with a buffer solution. In embodiments, the buffer solution comprises acetate, citrate, prolamine, carbonate, or phosphate or any combination thereof. In embodiments, the buffer solution is phosphate buffered saline (PBS).

In embodiments of the pharmaceutical compositions described herein, the iRNA (e.g., dsRNA) is targeted to hepatocytes.

In embodiments of the pharmaceutical compositions described herein, the composition is administered intravenously.

In embodiments of the pharmaceutical compositions described herein, the composition is administered subcutaneously.

In embodiments, a pharmaceutical composition comprises an iRNA (e.g., a dsRNA) described herein that comprises a ligand (e.g., a GalNAc ligand) that targets the iRNA (e.g., dsRNA) to hepatocytes.

In embodiments, a pharmaceutical composition comprises an iRNA (e.g., a dsRNA) described herein that comprises a ligand (e.g., a GalNAc ligand), and the pharmaceutical composition is administered subcutaneously. In embodiments, the ligand targets the iRNA (e.g., dsRNA) to hepatocytes.

In certain embodiments, a pharmaceutical composition, e.g., a composition described herein, includes a lipid formulation. In some embodiments, the RNAi agent is in a LNP formulation, e.g., a MC3 formulation. In some embodiments, the LNP formulation targets the RNAi agent to a particular cell, e.g., a liver cell, e.g., a hepatocyte. In embodiments, the lipid formulation is a LNP11 formulation. In embodiments, the composition is administered intravenously.

In another embodiment, the pharmaceutical composition is formulated for administration according to a dosage regimen described herein, e.g., not more than once every four weeks, not more than once every three weeks, not more than once every two weeks, or not more than once every week. In another embodiment, the administration of the pharmaceutical composition can be maintained for a month or longer, e.g., one, two, three, or six months, or one year or longer.

In another embodiment, a composition containing an iRNA featured in the invention, e.g., a dsRNA targeting ALAS1, is administered with a non-iRNA therapeutic agent, such as an agent known to treat a porphyria (e.g., AIP), or a symptom of a porphyria (e.g., pain). In another embodiment, a composition containing an iRNA featured in the invention, e.g., a dsRNA targeting AIP, is administered along with a non-iRNA therapeutic regimen, such as hemin or glucose (e.g., glucose infusion (e.g., IV glucose)). For example, an iRNA featured in the invention can be administered before, after, or concurrent with glucose, dextrose, or a similar treatment that serves to restore energy balance (e.g., total parenteral nutrition). An iRNA featured in the invention can also be administered before, after, or concurrent with the administration of a heme product (e.g., hemin, heme arginate, or heme albumin), and optionally also in combination with a glucose (e.g. IV glucose) or the like.

Typically, glucose administered for the treatment of a porphyria is administered intravenously (IV). Administration of glucose intravenously is referred to herein as "IV glucose." However, alternative embodiments in which glucose is administered by other means are also encompassed.

In one embodiment, an ALAS1 iRNA is administered to a patient, and then the non-iRNA agent or therapeutic regimen (e.g., glucose and/or a heme product) is administered to the patient (or vice versa). In another embodiment, an ALAS1 iRNA and the non-iRNA therapeutic agent or therapeutic regimen are administered at the same time.

In an aspect provided herein is a method of inhibiting ALAS1 expression in a cell, the method comprising: (a) introducing into the cell an iRNA (e.g. a dsRNA) described herein and (b) maintaining the cell of step (a) for a time sufficient to obtain degradation of the mRNA transcript of an ALAS1 gene, thereby inhibiting expression of the ALAS1 gene in the cell.

In an aspect provided herein is a method for reducing or inhibiting the expression of an ALAS1 gene in a cell (e.g., an erythroid cell or a liver cell, such as, e.g., a hepatocyte). The method includes:
(a) introducing into the cell a double-stranded ribonucleic acid (dsRNA), wherein the dsRNA includes at least two sequences that are complementary to each other. The dsRNA has a sense strand having a first sequence and an antisense strand having a second sequence; the antisense strand has a region of complementarity that is substantially complementary to at least a part of an mRNA encoding ALAS1, and where the region of complementarity is 30 nucleotides or less, i.e., 15-30 nucleotides in length, and generally 19-24 nucleotides in length, and where the dsRNA upon contact with a cell expressing ALAS1, inhibits expression of an ALAS1 gene by at least 10%, e.g., at least 20%, at least 30%, at least 40% or more; and (b) maintaining the cell of step (a) for a time sufficient to obtain degradation of the mRNA transcript of the ALAS1 gene, thereby reducing or inhibiting expression of an ALAS1 gene in the cell.

In embodiments of the foregoing methods of inhibiting ALAS1 expression in a cell, the cell is treated ex vivo, in vitro, or in vivo. In embodiments, the cell is a hepatocyte.

In embodiments, the cell is present in a subject in need of treatment, prevention and/or management of a disorder related to ALAS1 expression.

In embodiments, the disorder is a porphyria. In embodiments, the porphyria is acute intermittent porphyria or ALA-dehydratase deficiency porphyria.

In embodiments, the porphyria is a hepatic porphyria, e.g., a porphyria selected from acute intermittent porphyria (AIP) hereditary coproporphyria (HCP), variegate porphyria (VP), ALA deyhdratase deficiency porphyria (ADP), and hepatoerythropoietic porphyria. In embodiments, the porphyria is a homozygous dominant hepatic porphyria (e.g., homozygous dominant AIP, HCP, or VP) or hepatoerythropoietic porphyria. In embodiments, the porphyria is a dual porphyria.

In embodiments, the expression of ALAS1 is inhibited by at least 30%.

In embodiments, the iRNA (e.g., dsRNA) has an $IC_{50}$ in the range of 0.01-1 nM.

In certain embodiments, the cell (e.g., the hepatocyte) is a mammalian cell (e.g., a human, non-human primate, or rodent cell).

In one embodiment, the cell is treated ex vivo, in vitro, or in vivo (e.g., the cell is present in a subject (e.g., a patient in need of treatment, prevention and/or management of a disorder related to ALAS1 expression).

In one embodiment, the subject is a mammal (e.g., a human) at risk, or diagnosed with a porphyria, e.g., X-linked sideroblastic anemia (XLSA), ALA deyhdratase deficiency porphyria (ADP or Doss porphyria), acute intermittent porphyria (AIP), congenital erythropoietic porphyria (CEP), prophyria cutanea tarda (PCT), hereditary coproporphyria (coproporphyria, or HCP), variegate porphyria (VP), erythropoietic protoporphyria (EPP), or transient erythroporphyria of infancy. In some embodiments, the disorder is an acute hepatic porphyria, e.g., ALA deyhdratase deficiency porphyria (ADP), AIP, HCP, or VP. In specific embodiments, the disorder is ALA deyhdratase deficiency porphyria (ADP) or AIP.

In embodiments, the porphyria is a hepatic porphyria, e.g., a porphyria selected from acute intermittent porphyria (AIP) hereditary coproporphyria (HCP), variegate porphyria (VP), ALA deyhdratase deficiency porphyria (ADP), and hepatoerythropoietic porphyria. In embodiments, the porphyria is a homozygous dominant hepatic porphyria (e.g., homozygous dominant AIP, HCP, or VP) or hepatoerythropoietic porphyria, In embodiments, the porphyria is a dual porphyria.

In one embodiment, the dsRNA introduced reduces or inhibits expression of an ALAS1 gene in the cell.

In one embodiment, the dsRNA introduced reduces or inhibits expression of an ALAS1 gene, or the level of one or more porphyrins or porphyrin precursors (e.g., δ-aminolevulinic acid (ALA), porphopilinogen (PBG), hydroxymethylbilane (HMB), uroporphyrinogen I or III, coproporphyrinogen I or III, protoporphrinogen IX, and protoporphyrin IX) or porphyrin products or metabolites, by at least 5%, 10%, 15%, 20%, 25%, 30%, 35%, 40%, 45%, 50% or more compared to a reference, (e.g., an untreated cell or a cell treated with a non-targeting control dsRNA). Without being bound by theory, ALAS1 is the first enzyme of the porphyrin pathway. Thus, reducing expression of the ALAS1 gene is likely to reduce the level of one or more porphyrin precursors, porphyrins or porphyrin products or metabolites.

In other aspects, the invention provides methods for treating, preventing or managing pathological processes related to ALAS1 expression (e.g., pathological processes involving porphyrins, porphyrin precursors, or defects in the porphyrin pathway, such as, for example, porphyrias). In one embodiment, the method includes administering to a subject, e.g., a patient in need of such treatment, prevention or management, an effective (e.g., a therapeutically or prophylactically effective) amount of one or more of the iRNAs featured herein.

In an aspect provided herein is a method of treating and/or preventing a disorder related to ALAS1 expression comprising administering to a subject in need of such treatment a therapeutically effective amount of an iRNA (e.g., a dsRNA) described herein, or a composition comprising an iRNA (e.g., a dsRNA) described herein.

In an aspect provided herein is a method of treating and/or preventing a porphyria comprising administering to a subject in need of such treatment a double-stranded ribonucleic acid (dsRNA), wherein said dsRNA comprises a sense strand and an antisense strand 15-30 base pairs in length and the antisense strand is complementary to at least 15 contiguous nucleotides of SEQ ID NO:1 or SEQ ID NO:382.

In one embodiment, subject (e.g., the patient) has a porphyria. In another embodiment, the subject (e.g., patient) is at risk for developing a porphyria. In some embodiments, administration of the iRNA targeting ALAS1 alleviates or relieves the severity of at least one symptom of a disorder related to ALAS1 in the patient.

In one embodiment, the subject is a mammal (e.g., a human) at risk, or that has been diagnosed with, a disorder related to ALAS1 expression, e.g., a porphyria, e.g., X-linked sideroblastic anemia (XLSA), ALA deyhdratase deficiency porphyria (Doss porphyria), acute intermittent porphyria (AIP), congenital erythropoietic porphyria (CEP), prophyria cutanea tarda (PCT), hereditary coproporphyria (coproporphyria, or HCP), variegate porphyria (VP), erythropoietic protoporphyria (EPP), or transient erythroporphyria of infancy. In a further embodiment, the porphyria is an acute hepatic porphyria, e.g., ALA deyhdratase deficiency porphyria (ADP), AIP, HCP, or VP. In some such embodiments, the disorder is ALA deyhdratase deficiency porphyria (ADP) or AIP.

In embodiments the subject has, or is at risk for developing, a porphyria. In embodiments, the porphyria is a hepatic porphyria, e.g., a porphyria selected from acute intermittent porphyria (AIP) hereditary coproporphyria (HCP), variegate porphyria (VP), ALA deyhdratase deficiency porphyria (ADP), and hepatoerythropoietic porphyria. In embodiments, the porphyria is a homozygous dominant hepatic porphyria (e.g., homozygous dominant AIP, HCP, or VP) or hepatoerythropoietic porphyria, In embodiments, the porphyria is a dual porphyria.

In embodiments, a porphyria, a symptom of porphyria, a prodrome, or an attack of porphyria is induced by exposure to a precipitating factor, as described herein. In some embodiments, the precipitating factor is a chemical exposure. In some embodiments, the precipitating factor is a drug, e.g., a prescription drug or an over the counter drug. In some embodiments, the precipitating factor is the menstrual cycle, e.g., a particular phase of the menstrual cycle, e.g., the luteal phase.

In embodiments, the iRNA (e.g., dsRNA) or composition comprising the iRNA is administered after an acute attack of porphyria.

In embodiments, the iRNA (e.g., dsRNA) or composition comprising the iRNA is administered during an acute attack of porphyria.

In embodiments, the iRNA (e.g., dsRNA) or composition comprising the iRNA is administered prophylactically to prevent an acute attack of porphyria.

In embodiments, the iRNA (e.g., dsRNA) is formulated as an LNP formulation.

In embodiments, the iRNA (e.g., dsRNA) is in the form of a GalNAc conjugate.

In embodiments, iRNA (e.g., dsRNA) is administered at a dose of 0.05-50 mg/kg.

In embodiments, the iRNA (e.g., dsRNA) is administered at a concentration of 0.01 mg/kg-5 mg/kg bodyweight of the subject.

In embodiments, the iRNA (e.g., dsRNA) is formulated as an LNP formulation and is administered at a dose of 0.05-5 mg/kg.

In embodiments, the iRNA (e.g., dsRNA) is in the form of a GalNAc conjugate and is administered at a dose of 0.5-50 mg/kg.

In embodiments, the method decreases a level of a porphyrin or a porphyrin precursor in the subject.

In embodiments, the level is decreased by at least 10%, 20%, 30%, 40%, 50%, 60%, 70%, 80%, or 90%. In an embodiment, the level is decreased by at least 30%.

In embodiments, the porphyrin precursor is δ-aminolevulinic acid (ALA) or porphopilinogen (PBG).

In embodiments, the iRNA (e.g., dsRNA) has an $IC_{50}$ in the range of 0.01-1 nM.

In embodiments, a method described herein
(i) ameliorates a symptom associated with an ALAS1 related disorder (e.g., a porphyria)
(ii) inhibits ALAS1 expression in the subject,
(iii) decreases a level of a porphyrin precursor (e.g., ALA or PBG) or a porphyrin in the subject,
(iv) decreases frequency of acute attacks of symptoms associated with a porphyria in the subject, or
(v) decreases incidence of acute attacks of symptoms associated with a porphyria in the subject when the subject is exposed to a precipitating factor (e.g., the premenstrual phase or the luteal phase).

In embodiments, the method ameliorates pain and/or progressive neuropathy.

In embodiments, the iRNA (e.g., dsRNA) or composition comprising the iRNA is administered according to a dosing regimen.

In some embodiments, the iRNA (e.g., dsRNA) or composition comprising the iRNA is administered before or during an acute attack of porphyria. In some embodiments, the iRNA is administered before an acute attack of porphyria.

In some embodiments, the iRNA (e.g., dsRNA) or composition comprising the iRNA is administered during a prodrome. In embodiments, the prodrome is characterized by abdominal pain, nausea, psychological symptoms (e.g., anxiety), restlessness and/or insomnia.

In embodiments, the iRNA (e.g., dsRNA) or composition comprising the iRNA is administered during a particular phase of the menstrual cycle, e.g., during the luteal phase. In embodiments, the method ameliorates or prevents cyclical attacks of porphyria, e.g., by reducing the severity, duration, or frequency of attacks. In embodiments, the cyclical attacks are associated with a precipitating factor. In embodiments, the precipitating factor is the menstrual cycle, e.g., a particular phase of the menstrual cycle, e.g., the luteal phase.

In embodiments, the subject has an elevated level of ALA and/or PBG. In embodiments, the subject has or is at risk for developing a porphyria, e.g., a hepatic porphyria. In embodiments, the subject is asymptomatic. In embodiments, the subject carries a genetic alteration (e.g., a gene mutation) associated with a porphyria, as described herein.

In embodiments, the subject has or is at risk for developing a porphyria and suffers from pain (e.g., chronic pain, e.g., chronic neuropathic pain) and/or neuropathy (e.g., progressive neuropathy). In embodiments, the subject does not suffer from acute attacks but suffers from pain (e.g., chronic pain, e.g., chronic neuropathic pain) and/or neuropathy (e.g., progressive neuropathy). In embodiments, the pain is abdominal pain.

In embodiments, the subject (a) has an elevated level of ALA and/or PBG and (b) suffers from pain (e.g., chronic pain, e.g., chronic neuropathic pain) and/or neuropathy (e.g., progressive neuropathy). In embodiments, the pain is abdominal pain.

In embodiments, the subject has a plasma level and/or a urine level of ALA and/or PBG that is elevated. In embodiments, the elevated level of ALA and/or PBG is accompanied by other symptoms, e.g., pain (e.g., chronic pain, e.g., chronic neuropathic pain) or neuropathy (e.g., progressive neuropathy). In embodiments, the pain is abdominal pain. In embodiments, the subject is asymptomatic. In embodiments, the subject has a genetic mutation associated with a porphyria, e.g., a mutation as described herein.

In embodiments, the subject has a level (e.g., a plasma level or a urine level) of a porphyrin precursor, e.g., ALA and/or PBG, that is elevated, e.g., the level is greater than, or greater than or equal to, a reference value. In embodiments, the level is greater than the reference value. In embodiments, the reference value is two standard deviations above the mean level in a sample of healthy individuals. In embodiments, the reference value is an upper reference limit.

In embodiments, the subject has a plasma level and/or a urine level of ALA and/or PBG that is greater than, or greater than or equal to, 2 times, 3 times, 4 times, or 5 times that of an upper reference limit. As used herein, an "upper reference limit" refers to a level that is the upper limit of the 95% confidence interval for a reference sample, e.g., a sample of normal (e.g., wild type) or healthy individuals, e.g., individuals who do not carry a genetic mutation associated with a porphyria and/or individuals who do not suffer from a porphyria. In embodiments, the subject has a urine level of ALA and/or PBG that is greater than 2 to 4 times that of an upper reference limit. In embodiments, the subject has a urine level of ALA and/or PBG that is greater than 4 times that of an upper reference limit.

In embodiments, the reference value for plasma PBG is 0.12 μmol/L. In embodiments, the subject is a human and has a plasma PBG level that is greater than, or greater than or equal to, 0.12 μmol/L, 0.24 μmol/L, 0.36 μmol/L, 0.48 μmol/L, or 0.60 μmol/L. In embodiments, the subject is a human and has a plasma level of PBG that is greater than, or greater than or equal to, 0.48 μmol/L.

In embodiments, the reference value for urine PBG is 1.2 mmol/mol creatinine. In embodiments, the subject is a human and has a urine PBG level that is greater than, or greater than or equal to, 1.2 mmol/mol creatinine, 2.4 mmol/mol creatinine, 3.6 mmol/mol creatinine, 4.8 mmol/mol creatinine, or 6.0 mmol/mol creatinine. In embodiments, the subject is a human and has a urine level of PBG that is greater than, or greater than or equal to, 4.8 mmol/mol creatinine.

In embodiments, the reference value for plasma ALA is 0.12 µmol/L. In embodiments, the subject is a human and has a plasma ALA level that is greater than, or greater than or equal to, 0.12 µmol/L, 0.24 µmol/L, 0.36 µmol/L, 0.48 µmol/L, or 0.60 µmol/L. In embodiments, the subject is a human and has a plasma ALA level that is greater than, or greater than or equal to 0.48 µmol/L.

In embodiments, the reference value for urine ALA is 3.1 mmol/mol creatinine. In embodiments, the subject is a human and has a urine ALA level that is greater than, or greater than or equal to, 3.1 mmol/mol creatinine, 6.2 mmol/mol creatinine, 9.3 mmol/mol creatinine, 12.4 mmol/mol creatinine, or 15.5 mmol/mol creatinine.

In embodiments, the method decreases an elevated level of ALA and/or PBG. In embodiments, the method decreases pain (e.g., chronic pain, e.g. chronic neuropathic pain) and/or neuropathy (e.g., progressive neuropathy). In embodiments, the pain is abdominal pain. In embodiments, the pain is neuropathic pain (e.g., pain associated with the progressive neuropathy of acute porphyrias). The decrease in pain can include, e.g., prevention of pain, delay in the onset of pain, reduction in the frequency of pain, and/or reduction in severity of pain.

In embodiments, the method ameliorates or prevents acute attacks of porphyria, e.g., by reducing the severity, duration, or frequency of attacks.

In embodiments, the method decreases or prevents nerve damage.

In embodiments, the method prevents deterioration (e.g., prevents development of abnormalities) of or results in an improvement of clinical measures, e.g., clinical measures of muscle and/or nerve function, e.g., EMG and/or nerve conduction velocities.

In embodiments, the method is effective to reduce a level of ALA and/or PBG (e.g., a plasma or urine level of ALA and/or PBG). In embodiments, the method is effective to produce a predetermined reduction in the elevated level of ALA and/or PBG.

In embodiments, the predetermined reduction is a reduction to a value that is less than or equal to a reference value. In some embodiments, the reference value is an upper reference limit. In some embodiments, the reference value is the value that is two standard deviations above the mean level in a reference sample.

In embodiments, the iRNA (e.g., dsRNA) or composition comprising the iRNA is administered repeatedly, e.g., according to a dosing regimen.

In embodiments, the iRNA (e.g., dsRNA) or composition comprising the iRNA is administered prophylactically to a subject who is at risk for developing a porphyria. In embodiments, the iRNA (e.g., dsRNA) or composition comprising the iRNA is administered prophylactically beginning at puberty. In embodiments, the subject carries a genetic mutation associated with a porphyria and/or has an elevated level of ALA and/or PBG (e.g., an elevated plasma or urine level of ALA and/or PBG). In embodiments, the mutation makes an individual susceptible to an acute attack (e.g., upon exposure to a precipitating factor, e.g., a drug, dieting or other precipitating factor, e.g., a precipitating factor as disclosed herein). In embodiments, the mutation is associated with elevated levels of a porphyrin or a porphyrin precursor (e.g., ALA and/or PBG). In embodiments, the mutation is associated with chronic pain (e.g., chronic neuropathic pain) and/or neuropathy (e.g., progressive neuropathy).

In embodiments, the mutation is a mutation in the ALAS1 gene. In embodiments, the mutation is a mutation in the ALAS1 gene promoter, or in regions upstream or downstream from the ALAS1 gene. In embodiments, the mutation is a mutation in transcription factors or other genes that interact with ALAS1. In embodiments, the mutation is a mutation in a gene that encodes an enzyme in the heme biosynthetic pathway.

In embodiments, the iRNA (e.g., dsRNA) or composition comprising the iRNA is administered subcutaneously. In embodiments, the iRNA is in the form of a GalNAc conjugate. In embodiments, the iRNA (e.g., the dsRNA) is administered at a dose of 0.5-50 mg/kg.

In one aspect provided herein is a method of treating a subject with an elevated level of ALA and/or PBG, the method comprising administering to the subject a double-stranded ribonucleic acid (dsRNA), wherein said dsRNA comprises a sense strand and an antisense strand 15-30 base pairs in length and the antisense strand is complementary to at least 15 contiguous nucleotides of SEQ ID NO:1 or SEQ ID NO:382.

In one aspect provided herein is a method of treating a subject with an elevated level of ALA and/or PBG, the method comprising administering to the subject a therapeutically effective amount of an dsRNA or a composition comprising a dsRNA, as described herein.

In some embodiments, the methods described herein are effective to decrease the level of ALA and/or PBG. In some embodiments, the level of ALA and/or PBG is decreased such that it is less than, or less than or equal to, a reference value, e.g., an upper reference limit. In another aspect, the invention provides methods for decreasing a level of a porphyrin or a porphyrin precursor in a cell (e.g., an erythroid cell or a liver cell, such as, e.g., a hepatocyte). In one embodiment, the cell is treated ex vivo, in vitro, or in vivo (e.g., the cell is present in a subject (e.g., a patient in need of treatment, prevention and/or management of a disorder related to ALAS1 expression). The method includes contacting the cell with an effective amount of one or more of the iRNAs targeting ALAS1, e.g., one or more of the iRNAs disclosed herein, thereby decreasing the level of a porphyrin or a porphyrin precursor in the cell; or decreasing the level of a porphyrin or a porphyrin precursor in other cells, tissues, or fluids within a subject in which the cell is located; relative to the level prior to contacting. Such methods can be used to treat (e.g., ameliorate the severity) of disorders related to ALAS1 expression, such as porphyrias, e.g., AIP or ALA dehydratase deficiency porphyria.

In one embodiment, the contacting step is effected ex vivo, in vitro, or in vivo. For example, the cell can be present in a subject, e.g., a mammal (e.g., a human) at risk, or that has been diagnosed with, a porphyria. In an embodiment, the porphyria is an acute hepatic porphyria. In embodiments, the porphyria is a hepatic porphyria, e.g., a porphyria selected from acute intermittent porphyria (AIP), hereditary coproporphyria (HCP), variegate porphyria (VP), ALA dehydratase deficiency porphyria (ADP), and hepatoerythropoietic porphyria. In embodiments, the porphyria is a homozygous dominant hepatic porphyria (e.g., homozygous dominant AIP, HCP, or VP) or hepatoerythropoietic porphyria, In embodiments, the porphyria is a dual porphyria.

In an aspect provided herein is a method for decreasing a level of a porphyrin or a porphyrin precursor (e.g., ALA or PBG) in a cell, comprising contacting the cell with an iRNA (e.g. a dsRNA), as described herein, in an amount effective to decrease the level of the porphyrin or the porphyrin precursor in the cell. In embodiments, the cell is a hepatocyte. In embodiments, the porphyrin or porphyrin precursor is δ-aminolevulinic acid (ALA), porphopilinogen (PBG), hydroxymethylbilane (HMB), uroporphyrinogen I or III, coproporphyrinogen I or III, protoporphrinogen IX, or protoporphyrin IX. In embodiments, the porphyrin precursor is ALA or PBG.

In one embodiment, the cell is an erythroid cell. In a further embodiment, the cell is a liver cell (e.g., a hepatocyte).

In an aspect provided herein is a vector encoding at least one strand of an iRNA (e.g., a dsRNA) as described herein.

In an aspect provided herein is a vector encoding at least one strand of a dsRNA, wherein said dsRNA comprises a region of complementarity to at least a part of an mRNA encoding ALAS1, wherein said dsRNA is 30 base pairs or less in length, and wherein said dsRNA targets said mRNA for cleavage.

In embodiments, the region of complementarity is at least 15 nucleotides in length.

In embodiments, the region of complementarity is 19 to 21 nucleotides in length. In one aspect, the invention provides a vector for inhibiting the expression of an ALAS1 gene in a cell. In one embodiment, the vector comprises an iRNA as described herein. In one embodiment, the vector includes at least one regulatory sequence operably linked to a nucleotide sequence that encodes at least one strand of an iRNA as described herein. In one embodiment the vector comprises at least one strand of an ALAS1 iRNA.

In an aspect provided herein is a cell comprising a vector as described herein. In an aspect provided herein is a cell containing a vector for inhibiting the expression of an ALAS1 gene in a cell. The vector includes a regulatory sequence operably linked to a nucleotide sequence that encodes at least one strand of one of the iRNAs as described herein. In one embodiment, the cell is a liver cell (e.g., a hepatocyte). In another embodiment, the cell is an erythroid cell.

All publications, patent applications, patents, and other references mentioned herein are incorporated by reference in their entirety.

The details of various embodiments of the invention are set forth in the description below. Other features, objects, and advantages of the invention will be apparent from the description and the drawings, and from the claims.

DESCRIPTION OF THE DRAWINGS

FIG. 2 summarizes certain porphyrias associated with genetic errors in heme metabolism.

FIG. 3 depicts a human ALAS1 mRNA sequence transcript variant 1 (Ref. Seq. NM_000688.4 (GI:40316942, record dated Nov. 19, 2011), SEQ ID NO: 1).

FIG. 4 depicts a human ALAS1 mRNA sequence transcript variant 2 (Ref. Seq. NM_000688.5 (GI: 362999011, record dated Apr. 1, 2012), SEQ ID NO: 382).

FIG. 14 shows plasma ALA and PBG levels over time after phenobarbital administration and treatment with ALAS1 siRNA or control LUC siRNA.

DETAILED DESCRIPTION OF THE INVENTION iRNA directs the sequence-specific degradation of mRNA through a process known as RNA interference (RNAi). Described herein are iRNAs and methods of using them for inhibiting the expression of an ALAS1 gene in a cell or a mammal where the iRNA targets an ALAS1 gene. Also provided are compositions and methods for disorders related to ALAS1 expression, such as porphyrias (e.g., ALA deyhdratase deficiency porphyria (ADP or Doss porphyria), acute intermittent porphyria, congenital erythropoietic porphyria, prophyria cutanea tarda, hereditary coproporphyria (coproporphyria), variegate porphyria, erythropoietic protoporphyria (EPP), X-linked sideroblastic anemia (XLSA), and transient erythroporphyria of infancy).

Figure 1:
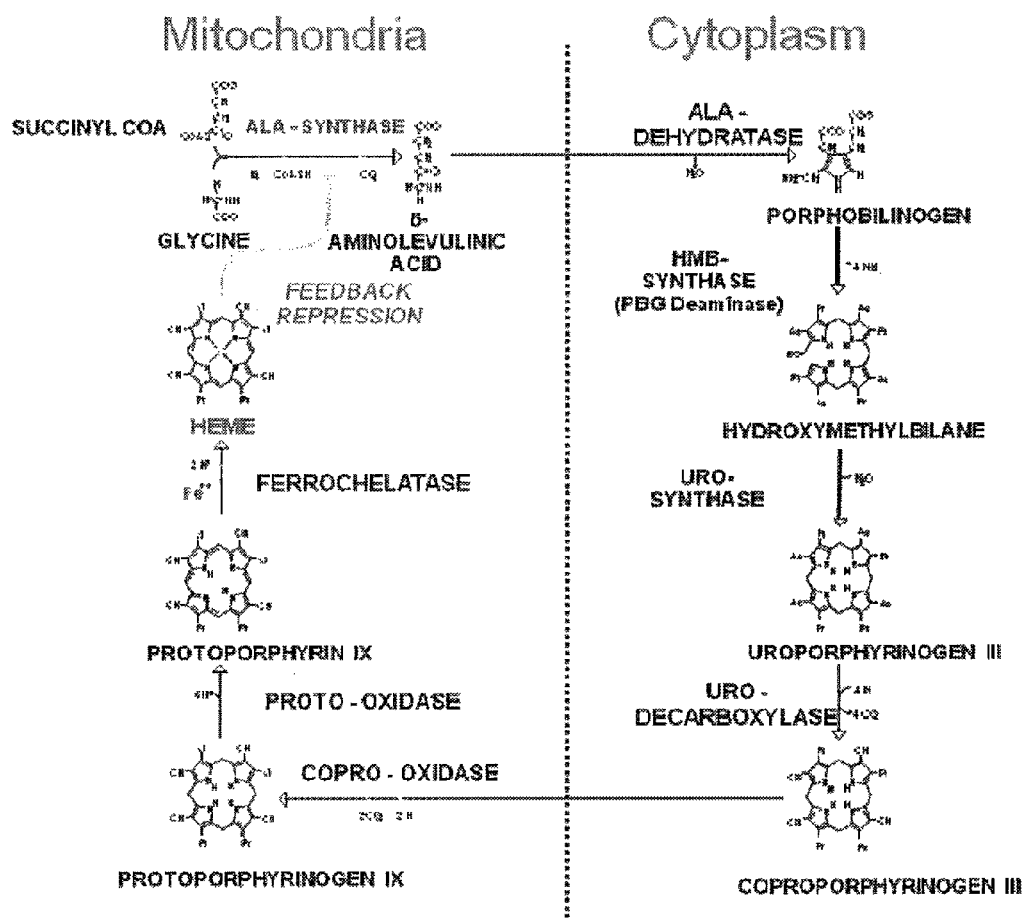
FIG. 1 depicts the heme biosynthetic pathway.

Porphyrias are inherited or acquired disorders that can be caused by decreased or enhanced activity of specific enzymes in the heme biosynthetic pathway, also referred to herein as the porphyrin pathway (See FIG. 1). Porphyrins are the main precursors of heme. Porphyrins and porphyrin precursors include δ-aminolevulinic acid (ALA), porphopilinogen (PBG), hydroxymethylbilane (HMB), uroporphyrinogen I or III, coproporphyrinogen I or III, protoporphrinogen IX, and protoporphyrin IX. Heme is an essential part of hemoglobin, myoglobin, catalases, peroxidases, and cytochromes, the latter including the respiratory and P450 liver cytochromes. Heme is synthesized in most or all human cells. About 85% of heme is made in erythroid cells, primarily for hemoglobin. Most of the remaining heme is made in the liver, 80% of which is used for the synthesis of cytochromes. Deficiency of specific enzymes in the porphyrin pathway leads to insufficient heme production and also to an accumulation of porphyrin precursors and/or porphyrins, which can be toxic to cell or organ function in high concentrations.

Porphyrias may manifest with neurological complications ("acute"), skin problems ("cutaneous") or both. Porphyrias may be classified by the primary site of the overproduction and accumulation of porphyrins or their precursors. In hepatic porphyrias, porphyrins and porphyrin precursors are overproduced predominantly in the liver, whereas in erythropoietic porphyrias, porphyrins are overproduced in the erythroid cells in the bone. The acute or hepatic porphyrias lead to dysfunction of the nervous system and neurologic manifestations that can affect both the central and peripheral nervous system, resulting in symptoms such as, for example, pain (e.g., abdominal pain and/or chronic neuropathic pain), vomiting, neuropathy (e.g., acute neuropathy, progressive neuropathy), muscle weakness, seizures, mental disturbances (e.g., hallucinations, depression anxiety, paranoia), cardiac arrhythmias, tachycardia, constipation, and diarrhea. The cutaneous or erythropoietic porphyrias primarily affect the skin, causing symptoms such as photosensitivity that can be painful, blisters, necrosis, itching, swelling, and increased hair growth on areas such as the forehead. Subsequent infection of skin lesions can lead to bone and tissue loss, as well as scarring, disfigurement, and loss of digits (e.g., fingers, toes). Most porphyrias are caused by mutations that encode enzymes in the heme biosynthetic pathway. A summary of porphyrias associated with genetic errors in heme metabolism is provided in FIG. 2.

Not all porphyrias are genetic. For example, patients with liver disease may develop porphyria as a result of liver dysfunction, and a transient form of erythroporphyria (transient erythroporphyria of infancy) has been described in infancy (see Crawford, R. I. et al, *J Am Acad Dermatol.* 1995 August; 33(2 Pt 2):333-6.) Patients with PCT can acquire the deficient activity of uroporphyrinogen decarboxylase (URO-D), due to the formation of a ORO-D enzyme with lower than normal enzymatic activity (see Phillips et al. *Blood,* 98:3179-3185, 2001.)

Acute intermittent porphyria (AIP) (also be referred to as porphobilinogen (PBG) deaminase deficiency, or hydroxymethylbilane synthase (HMBS) deficiency), is the most common type of acute hepatic porphyria. Other types of acute hepatic porphyrias include hereditary coproporphyria (HCP), variegate porphyria (VP), and ALA deyhdratase deficiency porphyria (ADP). Acute hepatic porphyrias are described, e.g., in Balwani, M and Desnick, R. J., *Blood,* 120:4496-4504, 2012.

AIP is typically an autosomal dominant disease that is characterized by a deficiency of the enzyme porphobilinogen deaminase (PBG deaminase); this enzyme is also known as hydroxymethylbilane synthase (HMB synthase or HMBS). PBG deaminase is the third enzyme of the heme biosynthetic pathway (see FIG. 1) and catalyzes the head to tail condensation of four porphobilinogen molecules into the linear tetrapyrrole, hydroxymethylbilane (HMB). Alternatively spliced transcript variants encoding different isoforms of PBG deaminase have been described. Mutations in the PBG deaminase gene are associated with AIP. Such mutations may lead to decreased amounts of PBG deaminase and/or decreased activity of PBG deaminase (affected individuals typically have a ~50% reduction in PBG deaminase activity).

There are at least two different models of the pathophysiology of AIP and other acute hepatic porphyrias (see, e.g., Lin C S-Y et al., Clinical Neurophysiology, 2011; 122:2336-44). According to one model, the decreased heme production resulting from PBG deaminase deficiency causes energy failure and axonal degeneration. According to the other, currently more favored model, the buildup of porphyrin precursors (e.g., ALA and PBG) results in neurotoxicity.

AIP has been found to have a prevalence as high as 1 in 10,000 in certain populations (e.g., in Northern Sweden; see Floderus Y, et al. Clin Genet. 2002; 62:288-97). The prevalence in the general population in United States and Europe, excluding the U.K., is estimated to be about 1 in 10,000 to 1 in 20,000. Clinical disease manifests itself in only approximately 10-15% of individuals who carry mutations that are known to be associated with AIP. However, the penetrance is as high as 40% in individuals with certain mutations (e.g., the W198X mutation). AIP is typically latent prior to puberty. Symptoms are more common in females than in males. The prevalence of the disease is probably underestimated due to its incomplete penetrance and long periods of latency. In the United States, it is estimated that there are about 2000 patients who have suffered at least one attack. It is estimated that there are about 150 active recurrent cases in France, Sweden, the U.K., and Poland; these patients are predominantly young women, with a median age of 30. See, e.g., Elder et al, *J Inherit Metab Dis.*, published online Nov. 1, 2012.

AIP affects, for example, the visceral, peripheral, autonomic, and central nervous systems. Symptoms of AIP are variable and include gastrointestinal symptoms (e.g., severe and poorly localized abdominal pain, nausea/vomiting, constipation, diarrhea, ileus), urinary symptoms (dysuria, urinary retention/incontinence, or dark urine), neurologic symptoms (e.g., sensory neuropathy, motor neuropathy (e.g., affecting the cranial nerves and/or leading to weakness in the arms or legs), seizures, neuropathic pain (e.g., pain associated with progressive neuropathy, e.g., chronic neuropathic pain), neuropsychiatric symptoms (e.g., mental confusion, anxiety, agitation, hallucination, hysteria, delirium, apathy, depression, phobias, psychosis, insomnia, somnolence, coma), autonomic nervous system involvement (resulting e.g., in cardiovascular symptoms such as tachycardia, hypertension, and/or arrhythmias, as well as other symptoms, such as, e.g., increased circulating catecholamine levels, sweating, restlessness, and/or tremor), dehydration, and electrolyte abnormalities. The most common symptoms are abdominal pain and tachycardia. In addition, patients frequently have chronic neuropathic pain and develop a progressive neuropathy. Patients with recurring attacks often have a prodrome. Permanent paralysis may occur after a severe attack. Recovery from severe attacks that are not promptly treated may take weeks or months. An acute attack may be fatal, for example, due to paralysis of respiratory muscles or cardiovascular failure from electrolyte imbalance. (See, e.g., Thunell S. Hydroxymethylbilane Synthase Deficiency. 2005 Sep. 27 [Updated 2011 Sep. 1]. In: Pagon R A, Bird T D, Dolan C R, et al., editors. GeneReviews™ [Internet]. Seattle (WA): University of Washington, Seattle; 1993—(hereinafter Thunell (1993)), which is hereby incorporated by reference in its entirety.) Prior to the availability of Hemin treatments, up to 20% of patients with AIP died from the disease.

In individuals who carry genes for AIP, the risk of hepatocellular cancer is increased. In those with recurrent attacks, the risk of hepatocellular cancer is particularly grave: after the age of 50, the risk is nearly 100-fold greater than in the general population.

Attacks of acute porphyria may be precipitated by endogenous or exogenous factors. The mechanisms by which such factors induce attacks may include, for example, increased demand for hepatic P450 enzymes and/or induction of ALAS1 activity in the liver. Increased demand for hepatic P450 enzymes results in decreased hepatic free heme, thereby inducing the synthesis of hepatic ALAS1.

Precipitating factors include fasting (or other forms of reduced or inadequate caloric intake, due to crash diets, long-distance athletics, etc.), metabolic stresses (e.g., infections, surgery, international air travel, and psychological stress), endogenous hormones (e.g., progesterone), cigarette smoking, lipid-soluble foreign chemicals (including, e.g., chemicals present in tobacco smoke, certain prescription drugs, organic solvents, biocides, components in alcoholic beverages), endocrine factors (e.g., reproductive hormones (women may experience exacerbations during the premenstrual period), synthetic estrogens, progesterones, ovulation stimulants, and hormone replacement therapy). See, for example, Thunell (1993).

Over 1000 drugs are contraindicated in the acute hepatic porphyrias (e.g., AIP, HCP, ADP, and VP) including, for example, alcohol, barbiturates, Carbamazepine, Carisoprodol, Clonazepam (high doses), Danazol, Diclofenac and possibly other NSAIDS, Ergots, estrogens, Ethyclorvynol, Glutethimide, Griseofulvin, Mephenyloin, Meprobamate (also mebutamate and tybutamate), Methyprylon, Metodopramide, Phenyloin, Primidone, progesterone and synthetic progestins, Pyrazinamide, Pyrazolones (aminopyrine and antipyrine), Rifampin, Succinimides (ethosuximide and methsuximide), sulfonamide antibiotics, and Valproic acid.

Objective signs of AIP include discoloration of the urine during an acute attack (the urine may appear red or redbrown), and increased concentrations of PBG and ALA in urine during an acute attack. Molecular genetic testing identifies mutations in the PBG deaminase (also known as HMBS) gene in more than 98% of affected individuals. Thunell (1993).

The differential diagnosis of porphyrias may involve determining the type of porphyria by measuring individual levels of porphyrins or porphyrin precursors (e.g., ALA, PBG) in the urine, feces, and/or plasma (e.g., by chromatography and fluorometry) during an attack. The diagnosis of AIP can be confirmed by establishing that erythrocyte PBG deaminase activity is at 50% or less of the normal level. DNA testing for mutations may be carried out in patients and at-risk family members. The diagnosis of AIP is typically confirmed by DNA testing to identify a specific caustative gene mutation (e.g., an HMBS mutation).

Treatment of acute attacks typically requires hospitalization to control and treat acute symptoms, including, e.g., abdominal pain, seizures, dehydration/hyponatremia, nausea/vomiting, tachycardia/hypertension, urinary retention/ileus. For example, abdominal pain may be treated, e.g., with narcotic analgesics, seizures may be treated with seizure precautions and possibly medications (although many anti-seizure medications are contraindicated), nausea/vomiting may be treated, e.g., with phenothiazines, and tachycardia/hypertension may be treated, e.g., with beta blockers. Treatment may include withdrawal of unsafe medications, monitoring of respiratory function, as well as muscle strength and neurological status. Mild attacks (e.g., those with no paresis or hyponatremia) may be treated with at least 300 g intravenous 10% glucose per day, although increasingly hemin is provided immediately. Severe attacks should be treated as soon as possible with intravenous hemin (3-4 mg/kg daily for 4-14 days) and with IV glucose while waiting for the IV hemin to take effect. Typically, attacks are treated with IV hemin for 4 days and with IV glucose while waiting for administration of the IV hemin.

Hemin (Panhematin® or hemin for injection, previously known as hematin) is the only heme product approved for use in the United States and was the first drug approved under the Orphan Drug Act. Panhematin® is hemin derived from processed red blood cells (PRBCs), and is Protoporphyrin IX containing a ferric iron ion (Heme B) with a chloride ligand. Heme acts to limit the hepatic and/or marrow synthesis of porphyrin. The exact mechanism by which hemin produces symptomatic improvement in patients with acute episodes of the hepatic porphyrias has not been elucidated; however, its action is likely due to the (feedback) inhibition of 8-aminolevulinic acid (ALA) synthase, the enzyme which limits the rate of the porphyrin/heme biosynthetic pathway. See Panhematin® product label, Lundbeck, Inc., October 2010. Inhibition of ALA synthase should result in reduced production of ALA and PBG as well as porphyrins and porphyrin intermediates.

Drawbacks of hemin include its delayed impact on clinical symptoms and its failure to prevent the recurrence of attacks. Adverse reactions associated with hemin administration may include thrombophlebitis, anticoagulation, thrombocytopenia, renal shut down, or iron overload, which is particularly likely in patients requiring multiple courses of hemin treatment for recurrent attacks. To prevent phlebitis, an indwelling venous catheter is needed for access in patients with recurrent attacks. Uncommonly reported side effects include fever, aching, malaise, hemolysis, anaphylaxis, and circulatory collapse. See Anderson, K. E., Approaches to Treatment and Prevention of Human Porphyrias, in *The Porphyrin Handbook: Medical Aspects of Porphyrins*, Edited by Karl M. Kadish, Kevin M. Smith, Roger Guilard (2003) (hereinafter Anderson).

Heme is difficult to prepare in a stable form for intravenous administration. It is insoluble at neutral pH but can be prepared as heme hydroxide at pH 8 or higher. Anderson. Panhematin is a lyophilized hemin preparation. When lyophilized hemin is solubilized for intravenous administration, degradation products form rapidly; these degradation products are responsible for a transient anticoagulant effect and for phlebitis at the site of infusion. Anderson. Heme albumin and heme arginate (Normosang, the European version of hemin) are more stable and may potentially cause less thrombophlebitis. However, heme arginate is not approved for use in the United States. Panhemin may be stabilized by solubilizing it for infusion in 30% human albumin rather than in sterile water; however, albumin adds intravascular volume-expanding effects and increases the cost of treatment as well as risk of pathogens since it is isolated from human blood. See, e.g., Anderson.

The successful treatment of an acute attack does not prevent or delay recurrence. There is a question of whether hemin itself can trigger recurring attacks due to induction of heme oxygenase. Nonetheless, in some areas (especially France), young women with multiply recurrent attacks are being treated with weekly hemin with the goal of achieving prophylaxis.

Limited experience with liver transplantation suggests that if successful, it is an effective treatment for AIP. There have been approximately 12 transplants in Europe in human patients, with curative or varying effects. Liver transplantation can restore normal excretion of ALA and PBG and prevent acute attacks. See, e.g., Dar, F. S. et al. *Hepatobiliary Pancreat. Dis. Int.*, 9(1):93-96 (2010). Furthermore, if the liver of a patient with AIP is transplanted into another patient ("domino transplant"), the patient receiving the transplant may develop AIP.

Among the long-term clinical effects of acute porphyrias is chronic neuropathic pain that may result from a progressive neuropathy due to neurotoxic effects, e.g., of elevated porphyrin precursors (e.g., ALA and/or PBG). Patients may suffer from neuropathic pain prior to or during an acute attack. Older patients may experience increased neuropathic pain with age for which various narcotic drugs are typically prescribed. Electromyogram abnormalities and decreased conduction times have been documented in patients with acute hepatic porphyrias. Of note, untreated, uninduced mice with AIP (PBG deaminase deficiency) develop a progressive motor neuropathy that has been shown to cause progressive quadriceps nerve axon degeneration and loss presumably due to constitutively elevated porphyrin precursor (ALA & PBG) levels, porphyrins and/or heme deficiency (Lindberg et al., J. Clin. Invest., 103(8): 1127-1134, 1999). In patients with acute porphyria (e.g., ADP, AIP, HCP, or VP), levels of porphyrin precursors (ALA & PBG) are often elevated in asymptomatic patients and in symptomatic patients between attacks. Thus, reduction of the porphyrin precursors and resumption of normal heme biosynthesis by reducing the level of ALAS1 expression and/or activity is expected to prevent and/or minimize development of chronic and progressive neuropathy. Treatment, e.g., chronic treatment (e.g., periodic treatment with iRNA as described herein, e.g., treatment according to a dosing regimen as described herein, e.g., weekly or biweekly treatment) can continuously reduce the ALAS1 expression in acute porphyria patients who have elevated levels of porphyrin precursors, porphyrins, porphyrin products or their metabolites. Such treatment may be provided as needed to prevent or reduce the frequency or severity of an individual patient's symptoms (e.g., pain and/or neuropathy) and/or to reduce a level of a porphyrin precursor, porphyrin, porphyrin product or metabolite.

The need exists for identifying novel therapeutics that can be used for the treatment of porphyrias. As discussed above, existing treatments such as hemin have numerous drawbacks. For example, the impact of hemin on clinical symptoms is delayed, it is expensive, and it may have side effects (e.g., thrombophlebitis, anticoagulation, thrombocytopenia, iron overload, renal shutdown). Novel therapeutics such as those described herein can address these drawbacks and the unmet needs of patients by, for example, acting faster, not inducing phlebitis, providing the convenience of subcutaneous administration, successfully preventing recurrent attacks, preventing or ameliorating pain (e.g., chronic neuropathic pain) and/or progressive neuropathy, and/or not causing certain adverse effects associated with hemin (e.g., iron overload, increased risk of hepatocellular cancer).

The present disclosure provides methods and iRNA compositions for modulating the expression of an ALAS1 gene. In certain embodiments, expression of ALAS1 is reduced or inhibited using an ALAS1-specific iRNA, thereby leading to a decreased expression of an ALAS1 gene. Reduced expression of an ALAS1 gene may reduce the level of one or more porphyrin precursors, porphyrins, or porphyrin products or metabolites. Decreased expression of an ALAS1 gene, as well as related decreases in the level of one or more porphyrin precursors and/or porphyrins, can be useful in treating disorders related to ALAS1 expression, e.g., porphyrias.

The iRNAs of the compositions featured herein include an RNA strand (the antisense strand) having a region which is 30 nucleotides or less in length, i.e., 15-30 nucleotides in length, generally 19-24 nucleotides in length, which region is substantially complementary to at least part of an mRNA transcript of an ALAS1 gene (also referred to herein as an "ALAS1-specific iRNA"). The use of such an iRNA enables the targeted degradation of mRNAs of genes that are implicated in pathologies associated with ALAS1 expression in mammals, e.g., porphyrias such as ALA dehydratase deficiency porphyria (Doss porphyria) or acute intermittent porphyria. Very low dosages of ALAS1-specific iRNAs can specifically and efficiently mediate RNAi, resulting in significant inhibition of expression of an ALAS1 gene. iRNAs targeting ALAS1 can specifically and efficiently mediate RNAi, resulting in significant inhibition of expression of an ALAS1 gene, e.g., in cell based assays. Thus, methods and compositions including these iRNAs are useful for treating pathological processes related to ALAS1 expression, such as porphyrias (e.g., X-linked sideroblastic anemia (XLSA), ALA deyhdratase deficiency porphyria (Doss porphyria), acute intermittent porphyria (AIP), congenital erythropoietic porphyria, prophyria cutanea tarda, hereditary coproporphyria (coproporphyria), variegate porphyria, erythropoietic protoporphyria (EPP), and transient erythroporphyria of infancy).

The following description discloses how to make and use compositions containing iRNAs to inhibit the expression of an ALAS1 gene, as well as compositions and methods for treating diseases and disorders caused by or modulated by the expression of this gene. Embodiments of the pharmaceutical compositions featured in the invention include an iRNA having an antisense strand comprising a region which is 30 nucleotides or less in length, generally 19-24 nucleotides in length, which region is substantially complementary to at least part of an RNA transcript of an ALAS1 gene, together with a pharmaceutically acceptable carrier. Embodiments of compositions featured in the invention also include an iRNA having an antisense strand having a region of complementarity which is 30 nucleotides or less in length, generally 19-24 nucleotides in length, and is substantially complementary to at least part of an RNA transcript of an ALAS1 gene.

Accordingly, in some aspects, pharmaceutical compositions containing an ALAS1 iRNA and a pharmaceutically acceptable carrier, methods of using the compositions to inhibit expression of an ALAS1 gene, and methods of using the pharmaceutical compositions to treat disorders related to ALAS1 expression are featured in the invention.

I. Definitions

For convenience, the meaning of certain terms and phrases used in the specification, examples, and appended claims, are provided below. If there is an apparent discrepancy between the usage of a term in other parts of this specification and its definition provided in this section, the definition in this section shall prevail.

"G," "C," "A," "T" and "U" each generally stand for a nucleotide that contains guanine, cytosine, adenine, thymidine and uracil as a base, respectively. However, it will be understood that the term "ribonucleotide" or "nucleotide" can also refer to a modified nucleotide, as further detailed below, or a surrogate replacement moiety. The skilled person is well aware that guanine, cytosine, adenine, and uracil may be replaced by other moieties without substantially altering the base pairing properties of an oligonucleotide comprising a nucleotide bearing such replacement moiety. For example, without limitation, a nucleotide comprising inosine as its base may base pair with nucleotides containing adenine, cytosine, or uracil. Hence, nucleotides containing uracil, guanine, or adenine may be replaced in the nucleotide sequences of dsRNA featured in the invention by a nucleotide containing, for example, inosine. In another example, adenine and cytosine anywhere in the oligonucleotide can be replaced with guanine and uracil, respectively to form G-U Wobble base pairing with the target mRNA. Sequences containing such replacement moieties are suitable for the compositions and methods featured in the invention.

As used herein, "ALAS1" (also known as ALAS-1; δ-aminolevulinate synthase 1; 6-ALA synthase 1; 5'-aminolevulinic acid synthase 1; ALAS-H; ALASH; ALAS-N; ALAS3; EC2.3.1.37; 5-aminolevulinate synthase, nonspecific, mitochondrial; ALAS; MIG4; OTTHUMP00000212619; OTTHUMP00000212620; OTTHUMP00000212621; OTTHUMP00000212622; migration-inducing protein 4; EC 2.3.1) refers to a nuclear-encoded mitochondrial enzyme that is the first and typically rate-limiting enzyme in the mammalian heme biosynthetic pathway. ALAS1 catalyzes the condensation of glycine with succinyl-CoA to form δ-aminolevulinic acid (ALA). The human ALAS1 gene is expressed ubiquitously, is found on chromosome 3p21.1 and typically encodes a sequence of 640 amino acids. In contrast, the ALAS-2 gene, which encodes an isozyme, is expressed only in erythrocytes, is found on chromosome Xp11.21, and typically encodes a sequence of 550 amino acids. As used herein an "ALAS1 protein" means any protein variant of ALAS1 from any species (e.g., human, mouse, non-human primate), as well as any mutants and fragments thereof that retain an ALAS1 activity. Similarly, an "ALAS1 transcript" refers to any transcript variant of ALAS1, from any species (e.g., human, mouse, non-human primate). A sequence of a human ALAS1 variant 1 mRNA transcript can be found at NM_000688.4 (FIG. 3; SEQ ID NO:1). Another version, a human ALAS1 variant 2 mRNA transcript, can be found at NM_000688.5 (FIG. 4; SEQ ID NO:382). The level of the mature encoded ALAS1 protein is regulated by heme: high levels of heme down-regulate the mature enzyme in mitochondria while low heme levels up-regulate. Multiple alternatively spliced variants, encoding the same protein, have been identified.

As used herein, the term "iRNA," "RNAi", "iRNA agent," or "RNAi agent" refers to an agent that contains RNA as that term is defined herein, and which mediates the targeted cleavage of an RNA transcript, e.g., via an RNA-induced silencing complex (RISC) pathway. In one embodiment, an iRNA as described herein effects inhibition of ALAS1 expression. Inhibition of ALAS1 expression may be assessed based on a reduction in the level of ALAS1 mRNA or a reduction in the level of the ALAS1 protein. As used herein, "target sequence" refers to a contiguous portion of the nucleotide sequence of an mRNA molecule formed during the transcription of an ALAS1 gene, including mRNA that is a product of RNA processing of a primary transcription product. The target portion of the sequence will be at least long enough to serve as a substrate for iRNA-directed cleavage at or near that portion. For example, the target sequence will generally be from 9-36 nucleotides in length, e.g., 15-30 nucleotides in length, including all subranges therebetween. As non-limiting examples, the target sequence can be from 15-30 nucleotides, 15-26 nucleotides, 15-23 nucleotides, 15-22 nucleotides, 15-21 nucleotides, 15-20 nucleotides, 15-19 nucleotides, 15-18 nucleotides, 15-17 nucleotides, 18-30 nucleotides, 18-26 nucleotides, 18-23 nucleotides, 18-22 nucleotides, 18-21 nucleotides, 18-20 nucleotides, 19-30 nucleotides, 19-26 nucleotides, 19-23 nucleotides, 19-22 nucleotides, 19-21 nucleotides, 19-20 nucleotides, 20-30 nucleotides, 20-26 nucleotides, 20-25 nucleotides, 20-24 nucleotides, 20-23 nucleotides, 20-22 nucleotides, 20-21 nucleotides, 21-30 nucleotides, 21-26 nucleotides, 21-25 nucleotides, 21-24 nucleotides, 21-23 nucleotides, or 21-22 nucleotides.

As used herein, the term "strand comprising a sequence" refers to an oligonucleotide comprising a chain of nucleotides that is described by the sequence referred to using the standard nucleotide nomenclature.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person. Such conditions can, for example, be stringent conditions, where stringent conditions may include: 400 mM NaCl, 40 mM PIPES pH 6.4, 1 mM EDTA, 50° C. or 70° C. for 12-16 hours followed by washing. Other conditions, such as physiologically relevant conditions as may be encountered inside an organism, can apply. The skilled person will be able to determine the set of conditions most appropriate for a test of complementarity of two sequences in accordance with the ultimate application of the hybridized nucleotides.

Complementary sequences within an iRNA, e.g., within a dsRNA as described herein, include base-pairing of the oligonucleotide or polynucleotide comprising a first nucleotide sequence to an oligonucleotide or polynucleotide comprising a second nucleotide sequence over the entire length of one or both nucleotide sequences. Such sequences can be referred to as "fully complementary" with respect to each other herein. However, where a first sequence is referred to as "substantially complementary" with respect to a second sequence herein, the two sequences can be fully complementary, or they may form one or more, but generally not more than 5, 4, 3 or 2 mismatched base pairs upon hybridization for a duplex up to 30 base pairs, while retaining the ability to hybridize under the conditions most relevant to their ultimate application, e.g., inhibition of gene expression via a RISC pathway. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, may yet be referred to as "fully complementary" for the purposes described herein.

"Complementary" sequences, as used herein, may also include, or be formed entirely from, non-Watson-Crick base pairs and/or base pairs formed from non-natural and modified nucleotides, in as far as the above requirements with respect to their ability to hybridize are fulfilled. Such non-Watson-Crick base pairs includes, but are not limited to, G:U Wobble or Hoogstein base pairing.

The terms "complementary," "fully complementary" and "substantially complementary" herein may be used with respect to the base matching between the sense strand and the antisense strand of a dsRNA, or between the antisense strand of an iRNA agent and a target sequence, as will be understood from the context of their use.

As used herein, a polynucleotide that is "substantially complementary to at least part of" a messenger RNA (mRNA) refers to a polynucleotide that is substantially complementary to a contiguous portion of the mRNA of interest (e.g., an mRNA encoding an ALAS1 protein). For example, a polynucleotide is complementary to at least a part of an ALAS1 mRNA if the sequence is substantially complementary to a non-interrupted portion of an mRNA encoding ALAS1. As another example, a polynucleotide is complementary to at least a part of an ALAS1 mRNA if the sequence is substantially complementary to a non-interrupted portion of an mRNA encoding ALAS1.

The term "double-stranded RNA" or "dsRNA," as used herein, refers to an iRNA that includes an RNA molecule or complex of molecules having a hybridized duplex region that comprises two anti-parallel and substantially complementary nucleic acid strands, which will be referred to as having "sense" and "antisense" orientations with respect to a target RNA. The duplex region can be of any length that permits specific degradation of a desired target RNA, e.g., through a RISC pathway, but will typically range from 9 to 36 base pairs in length, e.g., 15-30 base pairs in length. Considering a duplex between 9 and 36 base pairs, the duplex can be any length in this range, for example, 9, 10, 11, 12, 13, 14, 15, 16, 17, 18, 19, 20, 21, 22, 23, 24, 25, 26, 27, 28, 29, 30, 31, 32, 33, 34, 35, or 36 and any sub-range therein between, including, but not limited to 15-30 base pairs, 15-26 base pairs, 15-23 base pairs, 15-22 base pairs, 15-21 base pairs, 15-20 base pairs, 15-19 base pairs, 15-18 base pairs, 15-17 base pairs, 18-30 base pairs, 18-26 base pairs, 18-23 base pairs, 18-22 base pairs, 18-21 base pairs, 18-20 base pairs, 19-30 base pairs, 19-26 base pairs, 19-23 base pairs, 19-22 base pairs, 19-21 base pairs, 19-20 base pairs, 20-30 base pairs, 20-26 base pairs, 20-25 base pairs, 20-24 base pairs, 20-23 base pairs, 20-22 base pairs, 20-21 base pairs, 21-30 base pairs, 21-26 base pairs, 21-25 base pairs, 21-24 base pairs, 21-23 base pairs, or 21-22 base pairs. dsRNAs generated in the cell by processing with Dicer and similar enzymes are generally in the range of 19-22 base pairs in length. One strand of the duplex region of a dsDNA comprises a sequence that is substantially complementary to a region of a target RNA. The two strands forming the duplex structure can be from a single RNA molecule having at least one self-complementary region, or can be formed from two or more separate RNA molecules. Where the duplex region is formed from two strands of a single molecule, the molecule can have a duplex region separated by a single stranded chain of nucleotides (herein referred to as a "hairpin loop") between the 3'-end of one strand and the 5'-end of the respective other strand forming the duplex structure. The hairpin loop can comprise at least one unpaired nucleotide; in some embodiments the hairpin loop can comprise at least 3, at least 4, at least 5, at least 6, at least 7, at least 8, at least 9, at least 10, at least 20, at least 23 or more unpaired nucleotides. Where the two substantially complementary strands of a dsRNA are comprised by separate RNA molecules, those molecules need not, but can be covalently connected. Where the two strands are connected covalently by means other than a hairpin loop, the connecting structure is referred to as a "linker." The term "siRNA" is also used herein to refer to a dsRNA as described above.

In another embodiment, the iRNA agent may be a "single-stranded siRNA" that is introduced into a cell or organism to inhibit a target mRNA. Single-stranded RNAi agents bind to the RISC endonuclease Argonaute 2, which then cleaves the target mRNA. The single-stranded siRNAs are generally 15-30 nucleotides and are chemically modified. The design and testing of single-stranded siRNAs are described in U.S. Pat. No. 8,101,348 and in Lima et al., (2012) *Cell* 150: 883-894, the entire contents of each of which are hereby incorporated herein by reference. Any of the antisense nucleotide sequences described herein (e.g., sequences provided in Tables 2, 3, 6, 7, 8, 9, 14, 15, 18 and 20) may be used as a single-stranded siRNA as described herein or as chemically modified by the methods described in Lima et al., (2012) *Cell* 150:883-894.

In another aspect, the RNA agent is a "single-stranded antisense RNA molecule". An single-stranded antisense RNA molecule is complementary to a sequence within the target mRNA. Single-stranded antisense RNA molecules can inhibit translation in a stoichiometric manner by base pairing to the mRNA and physically obstructing the translation machinery, see Dias, N. et al., (2002) *Mol Cancer Ther* 1:347-355. Alternatively, the single-stranded antisense molecules inhibit a target mRNA by hydridizing to the target and cleaving the target through an RNaseH cleavage event. The single-stranded antisense RNA molecule may be about 10 to about 30 nucleotides in length and have a sequence that is complementary to a target sequence. For example, the single-stranded antisense RNA molecule may comprise a sequence that is at least about 10, 11, 12, 13, 14, 15, 16, 17, 18, 19, 20, or more contiguous nucleotides from any one of the antisense nucleotide sequences described herein, e.g., sequences provided in any one of Tables 2, 3, 6, 7, 8, 9, 14, 15, 18 and 20.

The skilled artisan will recognize that the term "RNA molecule" or "ribonucleic acid molecule" encompasses not only RNA molecules as expressed or found in nature, but also analogs and derivatives of RNA comprising one or more ribonucleotide/ribonucleoside analogs or derivatives as described herein or as known in the art. Strictly speaking, a "ribonucleoside" includes a nucleoside base and a ribose sugar, and a "ribonucleotide" is a ribonucleoside with one, two or three phosphate moieties. However, the terms "ribonucleoside" and "ribonucleotide" can be considered to be equivalent as used herein. The RNA can be modified in the nucleobase structure or in the ribose-phosphate backbone structure, e.g., as described herein below. However, the molecules comprising ribonucleoside analogs or derivatives must retain the ability to form a duplex. As non-limiting examples, an RNA molecule can also include at least one modified ribonucleoside including but not limited to a 2'-O-methyl modified nucleostide, a nucleoside comprising a 5' phosphorothioate group, a terminal nucleoside linked to a cholesteryl derivative or dodecanoic acid bisdecylamide group, a locked nucleoside, an abasic nucleoside, a 2'-deoxy-2'-fluoro modified nucleoside, a 2'-amino-modified nucleoside, 2'-alkyl-modified nucleoside, morpholino nucleoside, a phosphoramidate or a non-natural base comprising nucleoside, or any combination thereof. Alternatively, an RNA molecule can comprise at least two modified ribonucleosides, at least 3, at least 4, at least 5, at least 6, at least 7, at least 8, at least 9, at least 10, at least 15, at least 20 or more, up to the entire length of the dsRNA molecule. The modifications need not be the same for each of such a plurality of modified ribonucleosides in an RNA molecule. In one embodiment, modified RNAs contemplated for use in methods and compositions described herein are peptide nucleic acids (PNAs) that have the ability to form the required duplex structure and that permit or mediate the specific degradation of a target RNA, e.g., via a RISC pathway.

In one aspect, a modified ribonucleoside includes a deoxyribonucleoside. In such an instance, an iRNA agent can comprise one or more deoxynucleosides, including, for example, a deoxynucleoside overhang(s), or one or more deoxynucleosides within the double stranded portion of a dsRNA. However, it is self evident that under no circumstances is a double stranded DNA molecule encompassed by the term "iRNA."

In one aspect, an RNA interference agent includes a single stranded RNA that interacts with a target RNA sequence to direct the cleavage of the target RNA. Without wishing to be bound by theory, long double stranded RNA introduced into cells is broken down into siRNA by a Type III endonuclease known as Dicer (Sharp et al., *Genes Dev.* 2001, 15:485). Dicer, a ribonuclease-III-like enzyme, processes the dsRNA into 19-23 base pair short interfering RNAs with characteristic two base 3' overhangs (Bernstein, et al., (2001) Nature 409:363). The siRNAs are then incorporated into an RNA-induced silencing complex (RISC) where one or more helicases unwind the siRNA duplex, enabling the complementary antisense strand to guide target recognition (Nykanen, et al., (2001) *Cell* 107:309). Upon binding to the appropriate target mRNA, one or more endonucleases within the RISC cleaves the target to induce silencing (Elbashir, et al., (2001) *Genes Dev.* 15:188). Thus, in one aspect the invention relates to a single stranded RNA that promotes the formation of a RISC complex to effect silencing of the target gene.

As used herein, the term "nucleotide overhang" refers to at least one unpaired nucleotide that protrudes from the duplex structure of an iRNA, e.g., a dsRNA. For example, when a 3'-end of one strand of a dsRNA extends beyond the 5'-end of the other strand, or vice versa, there is a nucleotide overhang. A dsRNA can comprise an overhang of at least one nucleotide; alternatively the overhang can comprise at least two nucleotides, at least three nucleotides, at least four nucleotides, at least five nucleotides or more. A nucleotide overhang can comprise or consist of a nucleotide/nucleoside analog, including a deoxynucleotide/nucleoside. The overhang(s) may be on the sense strand, the antisense strand or any combination thereof. Furthermore, the nucleotide(s) of an overhang can be present on the 5' end, 3' end or both ends of either an antisense or sense strand of a dsRNA.

In one embodiment, the antisense strand of a dsRNA has a 1-10 nucleotide overhang at the 3' end and/or the 5' end. In one embodiment, the sense strand of a dsRNA has a 1-10 nucleotide overhang at the 3' end and/or the 5' end. In another embodiment, one or more of the nucleotides in the overhang is replaced with a nucleoside thiophosphate.

The terms "blunt" or "blunt ended" as used herein in reference to a dsRNA mean that there are no unpaired nucleotides or nucleotide analogs at a given terminal end of a dsRNA, i.e., no nucleotide overhang. One or both ends of a dsRNA can be blunt. Where both ends of a dsRNA are blunt, the dsRNA is said to be blunt ended. To be clear, a "blunt ended" dsRNA is a dsRNA that is blunt at both ends, i.e., no nucleotide overhang at either end of the molecule. Most often such a molecule will be double-stranded over its entire length.

The term "antisense strand" or "guide strand" refers to the strand of an iRNA, e.g., a dsRNA, which includes a region that is substantially complementary to a target sequence. As used herein, the term "region of complementarity" refers to the region on the antisense strand that is substantially complementary to a sequence, for example a target sequence, as defined herein. Where the region of complementarity is not fully complementary to the target sequence, the mismatches may be in the internal or terminal regions of the molecule. Generally, the most tolerated mismatches are in the terminal regions, e.g., within 5, 4, 3, or 2 nucleotides of the 5' and/or 3' terminus.

The term "sense strand," or "passenger strand" as used herein, refers to the strand of an iRNA that includes a region that is substantially complementary to a region of the antisense strand as that term is defined herein.

As used herein, the term "SNALP" refers to a stable nucleic acid-lipid particle. A SNALP represents a vesicle of lipids coating a reduced aqueous interior comprising a nucleic acid such as an iRNA or a plasmid from which an iRNA is transcribed. SNALPs are described, e.g., in U.S. Patent Application Publication Nos. 20060240093, 20070135372, and in International Application No. WO 2009082817. These applications are incorporated herein by reference in their entirety.

"Introducing into a cell," when referring to an iRNA, means facilitating or effecting uptake or absorption into the cell, as is understood by those skilled in the art. Absorption or uptake of an iRNA can occur through unaided diffusive or active cellular processes, or by auxiliary agents or devices. The meaning of this term is not limited to cells in vitro; an iRNA may also be "introduced into a cell," wherein the cell is part of a living organism. In such an instance, introduction into the cell will include the delivery to the organism. For example, for in vivo delivery, iRNA can be injected into a tissue site or administered systemically. In vivo delivery can also be by a β-glucan delivery system, such as those described in U.S. Pat. Nos. 5,032,401 and 5,607,677, and U.S. Publication No. 2005/0281781, which are hereby incorporated by reference in their entirety. In vitro introduction into a cell includes methods known in the art such as electroporation and lipofection. Further approaches are described herein below or known in the art.

As used herein, the term "modulate the expression of," refers to at an least partial "inhibition" or partial "activation" of an ALAS1 gene expression in a cell treated with an iRNA composition as described herein compared to the expression of ALAS1 in a control cell. A control cell includes an untreated cell, or a cell treated with a non-targeting control iRNA.

The terms "activate," "enhance," "up-regulate the expression of," "increase the expression of," and the like, in so far as they refer to an ALAS1 gene, herein refer to the at least partial activation of the expression of an ALAS1 gene, as manifested by an increase in the amount of ALAS1 mRNA, which may be isolated from or detected in a first cell or group of cells in which an ALAS1 gene is transcribed and which has or have been treated such that the expression of an ALAS1 gene is increased, as compared to a second cell or group of cells substantially identical to the first cell or group of cells but which has or have not been so treated (control cells).

In one embodiment, expression of an ALAS1 gene is activated by at least about 10%, 15%, 20%, 25%, 30%, 35%, 40%, 45%, or 50% by administration of an iRNA as described herein. In some embodiments, an ALAS1 gene is activated by at least about 60%, 70%, or 80% by administration of an iRNA featured in the invention. In some embodiments, expression of an ALAS1 gene is activated by at least about 85%, 90%, or 95% or more by administration of an iRNA as described herein. In some embodiments, the ALAS1 gene expression is increased by at least 1-fold, at least 2-fold, at least 5-fold, at least 10-fold, at least 50-fold, at least 100-fold, at least 500-fold, at least 1000 fold or more in cells treated with an iRNA as described herein compared to the expression in an untreated cell. Activation of expression by small dsRNAs is described, for example, in Li et al., 2006 *Proc. Natl. Acad. Sci. U.S.A.* 103:17337-42, and in US20070111963 and US2005226848, each of which is incorporated herein by reference.

The terms "silence," "inhibit expression of," "down-regulate expression of," "suppress expression of," and the like, in so far as they refer to an ALAS1 gene, herein refer to the at least partial suppression of the expression of an ALAS1 gene, as assessed, e.g., based on on ALAS1 mRNA expression, ALAS1 protein expression, or another parameter functionally linked to ALAS1 gene expression (e.g., ALA or PBG concentrations in plasma or urine). For example, inhibition of ALAS1 expression may be manifested by a reduction of the amount of ALAS1 mRNA which may be isolated from or detected in a first cell or group of cells in which an ALAS1 gene is transcribed and which has or have been treated such that the expression of an ALAS1 gene is inhibited, as compared to a control. The control may be a second cell or group of cells substantially identical to the first cell or group of cells, except that the second cell or group of cells have not been so treated (control cells). The degree of inhibition is usually expressed as a percentage of a control level, e.g., $$\frac{(mRNA \text{ in control cells}) - (mRNA \text{ in treated cells})}{(mRNA \text{ in control cells})} \cdot 100\%$$

Alternatively, the degree of inhibition may be given in terms of a reduction of a parameter that is functionally linked to ALAS1 gene expression, e.g., the amount of protein encoded by an ALAS1 gene, or the level of one or more porphyrins. The reduction of a parameter functionally linked to ALAS1 gene expression may similarly be expressed as a percentage of a control level. In principle, ALAS1 gene silencing may be determined in any cell expressing ALAS1, either constitutively or by genomic engineering, and by any appropriate assay. However, when a reference is needed in order to determine whether a given iRNA inhibits the expression of the ALAS1 gene by a certain degree and therefore is encompassed by the instant invention, the assays provided in the Examples below shall serve as such reference.

For example, in certain instances, expression of an ALAS1 gene is suppressed by at least about 10%, 15%, 20%, 25%, 30%, 35%, 40%, 45%, or 50% by administration of an iRNA featured in the invention. In some embodiments, an ALAS1 gene is suppressed by at least about 60%, 65%, 70%, 75%, or 80% by administration of an iRNA featured in the invention. In some embodiments, an ALAS1 gene is suppressed by at least about 85%, 90%, 95%, 98%, 99%, or more by administration of an iRNA as described herein.

As used herein in the context of ALAS1 expression, the terms "treat," "treating," "treatment," and the like, refer to relief from or alleviation of pathological processes related to ALAS1 expression (e.g., pathological processes involving porphyrins or defects in the porphyrin pathway, such as, for example, porphyrias). In the context of the present invention insofar as it relates to any of the other conditions recited herein below (other than pathological processes related to ALAS1 expression), the terms "treat," "treatment," and the like mean to prevent, relieve or alleviate at least one symptom associated with such condition, or to slow or reverse the progression or anticipated progression of such condition. For example, the methods featured herein, when employed to treat porphyria, may serve to reduce or prevent one or more symptoms associated with porphyria (e.g., pain), to reduce the severity or frequency of attacks associated with porphyria, to reduce the likelihood that an attack of one or more symptoms associated with porphyria will occur upon exposure to a precipitating condition, to shorten an attack associated with porphyria, and/or to reduce the risk of developing conditions associated with porphyria (e.g., hepatocellular cancer or neuropathy (e.g., progressive neuropathy)). Thus, unless the context clearly indicates otherwise, the terms "treat," "treatment," and the like are intended to encompass prophylaxis, e.g., prevention of disorders and/or symptoms of disorders related to ALAS1 expression.

By "lower" in the context of a disease marker or symptom is meant a statistically or clinically significant decrease in such level. The decrease can be, for example, at least 10%, at least 20%, at least 30%, at least 40% or more, and is typically down to a level accepted as within the range of normal for an individual without such disorder.

As used herein, the phrases "therapeutically effective amount" and "prophylactically effective amount" refer to an amount that provides a therapeutic benefit in the treatment, prevention, or management of pathological processes related to ALAS1 expression. The specific amount that is therapeutically effective can be readily determined by an ordinary medical practitioner, and may vary depending on factors known in the art, such as, for example, the type of pathological process, the patient's history and age, the stage of pathological process, and the administration of other agents.

As used herein, a "pharmaceutical composition" comprises a pharmacologically effective amount of an iRNA and a pharmaceutically acceptable carrier. As used herein, "pharmacologically effective amount," "therapeutically effective amount" or simply "effective amount" refers to that amount of an iRNA effective to produce the intended pharmacological, therapeutic or preventive result. For example, in a method of treating a disorder related to ALAS1 expression (e.g., in a method of treating a porphyria), an effective amount includes an amount effective to reduce one or more symptoms associated with a porphyria, an amount effective to reduce the frequency of attacks, an amount effective to reduce the likelihood that an attack of one or more symptoms associated with porphyria will occur upon exposure to a precipitating factor, or an amount effective to reduce the risk of developing conditions associated with porphyria (e.g., neuropathy (e.g., progressive neuropathy), hepatocellular cancer). For example, if a given clinical treatment is considered effective when there is at least a 10% reduction in a measurable parameter associated with a disease or disorder, a therapeutically effective amount of a drug for the treatment of that disease or disorder is the amount necessary to effect at least a 10% reduction in that parameter. For example, a therapeutically effective amount of an iRNA targeting ALAS1 can reduce ALAS1 protein levels by any measurable amount, e.g., by at least 10%, 20%, 30%, 40% or 50%.

The term "pharmaceutically acceptable carrier" refers to a carrier for administration of a therapeutic agent. Such carriers include, but are not limited to, saline, buffered saline, dextrose, water, glycerol, ethanol, and combinations thereof. The term specifically excludes cell culture medium. For drugs administered orally, pharmaceutically acceptable carriers include, but are not limited to pharmaceutically acceptable excipients such as inert diluents, disintegrating agents, binding agents, lubricating agents, sweetening agents, flavoring agents, coloring agents and preservatives. Suitable inert diluents include sodium and calcium carbonate, sodium and calcium phosphate, and lactose, while corn starch and alginic acid are suitable disintegrating agents. Binding agents may include starch and gelatin, while the lubricating agent, if present, will generally be magnesium stearate, stearic acid or talc. If desired, the tablets may be coated with a material such as glyceryl monostearate or glyceryl distearate, to delay absorption in the gastrointestinal tract. Agents included in drug formulations are described further herein below.

The term "about" when referring to a number or a numerical range means that the number or numerical range referred to is an approximation within experimental variability (or within statistical experimental error), and thus the number or numerical range may vary from, for example, between 1% and 15% of the stated number or numerical range.

II. Double-Stranded Ribonucleic Acid (dsRNA)

Described herein are iRNA agents that inhibit the expression of an ALAS1 gene. In one embodiment, the iRNA agent includes double-stranded ribonucleic acid (dsRNA) molecules for inhibiting the expression of an ALAS1 gene in a cell or in a subject (e.g., in a mammal, e.g., in a human having a porphyria), where the dsRNA includes an antisense strand having a region of complementarity which is complementary to at least a part of an mRNA formed in the expression of an ALAS1 gene, and where the region of complementarity is 30 nucleotides or less in length, generally 19-24 nucleotides in length, and where the dsRNA, upon contact with a cell expressing the ALAS1 gene, inhibits the expression of the ALAS1 gene by at least 10% as assayed by, for example, a PCR or branched DNA (bDNA)-based method, or by a protein-based method, such as by Western blot. In one embodiment, the iRNA agent activates the expression of an ALAS1 gene in a cell or mammal. Expression of an ALAS1 gene in cell culture, such as in COS cells, HeLa cells, primary hepatocytes, HepG2 cells, primary cultured cells or in a biological sample from a subject can be assayed by measuring ALAS1 mRNA levels, such as by bDNA or TaqMan assay, or by measuring protein levels, such as by immunofluorescence analysis, using, for example, Western Blotting or flow cytometric techniques.

A dsRNA includes two RNA strands that are sufficiently complementary to hybridize to form a duplex structure under conditions in which the dsRNA will be used. One strand of a dsRNA (the antisense strand) includes a region of complementarity that is substantially complementary, and generally fully complementary, to a target sequence, derived from the sequence of an mRNA formed during the expression of an ALAS1 gene. The other strand (the sense strand) includes a region that is complementary to the antisense strand, such that the two strands hybridize and form a duplex structure when combined under suitable conditions. Generally, the duplex structure is between 15 and 30 inclusive, more generally between 18 and 25 inclusive, yet more generally between 19 and 24 inclusive, and most generally between 19 and 21 base pairs in length, inclusive. Similarly, the region of complementarity to the target sequence is between 15 and 30 inclusive, more generally between 18 and 25 inclusive, yet more generally between 19 and 24 inclusive, and most generally between 19 and 21 nucleotides in length, inclusive. In some embodiments, the dsRNA is between 15 and 20 nucleotides in length, inclusive, and in other embodiments, the dsRNA is between 25 and 30 nucleotides in length, inclusive. As the ordinarily skilled person will recognize, the targeted region of an RNA targeted for cleavage will most often be part of a larger RNA molecule, often an mRNA molecule. Where relevant, a "part" of an mRNA target is a contiguous sequence of an mRNA target of sufficient length to be a substrate for RNAi-directed cleavage (i.e., cleavage through a RISC pathway). dsRNAs having duplexes as short as 9 base pairs can, under some circumstances, mediate RNAi-directed RNA cleavage. Most often a target will be at least 15 nucleotides in length, e.g., 15-30 nucleotides in length.

One of skill in the art will also recognize that the duplex region is a primary functional portion of a dsRNA, e.g., a duplex region of 9 to 36, e.g., 15-30 base pairs. Thus, in one embodiment, to the extent that it becomes processed to a functional duplex of e.g., 15-30 base pairs that targets a desired RNA for cleavage, an RNA molecule or complex of RNA molecules having a duplex region greater than 30 base pairs is a dsRNA. Thus, an ordinarily skilled artisan will recognize that in one embodiment, then, an miRNA is a dsRNA. In another embodiment, a dsRNA is not a naturally occurring miRNA. In another embodiment, an iRNA agent useful to target ALAS1 expression is not generated in the target cell by cleavage of a larger dsRNA.

A dsRNA as described herein may further include one or more single-stranded nucleotide overhangs. The dsRNA can be synthesized by standard methods known in the art as further discussed below, e.g., by use of an automated DNA synthesizer, such as are commercially available from, for example, Biosearch, Applied Biosystems, Inc. In one embodiment, an ALAS1 gene is a human ALAS1 gene. In another embodiment the ALAS1 gene is a mouse or a rat ALAS1 gene. In specific embodiments, the first sequence is a sense strand of a dsRNA that includes a sense sequence from Table 2 or Table 3, and the second sequence is an antisense strand of a dsRNA that includes an antisense sequence from Table 2 or Table 3. In embodiments, the first sequence is a sense strand of a dsRNA that includes a sense sequence from Table 2, 3, 6, 7, 8, 9, 14, or 15, and the second sequence is an antisense strand of a dsRNA that includes an antisense sequence from Table 2, 3, 6, 7, 8, 9, 14, or 15. In embodiments, the first sequence is a sense strand of a dsRNA that includes a sense sequence from Table 2, 3, 6, 7, 8, 9, 14, 15, 18 or 20, and the second sequence is an antisense strand of a dsRNA that includes an antisense sequence from Table 2, 3, 6, 7, 8, 9, 14, 15, 18 or 20. Alternative dsRNA agents that target sequences other than those of the dsRNAs disclosed herein (e.g. in Table 2 or Table 3) can readily be determined using the target sequence and the flanking ALAS1 sequence.

In one aspect, a dsRNA will include at least sense and antisense nucleotide sequences, whereby the sense strand is selected from the groups of sequences provided in Tables 2 and 3, and the corresponding antisense strand of the sense strand is selected from Tables 2 and 3. In a further aspect, a dsRNA will include at least sense and antisense nucleotide sequences, whereby the sense strand is selected from the groups of sequences provided in Tables 2, 3, 6, 7, 8, 9, 14, and 15, and the corresponding antisense strand of the sense strand is selected from Tables 2, 3, 6, 7, 8, 9, 14, and 15. In a further aspect, a dsRNA will include at least sense and antisense nucleotide sequences, whereby the sense strand is selected from the groups of sequences provided in Tables 2, 3, 6, 7, 8, 9, 14, 15, 18 and 20, and the corresponding antisense strand of the sense strand is selected from Tables 2, 3, 6, 7, 8, 9, 14, 15, 18 and 20. In these aspects, one of the two sequences is complementary to the other of the two sequences, with one of the sequences being substantially complementary to a sequence of an mRNA generated by the expression of an ALAS1 gene. As such, a dsRNA will include two oligonucleotides, where one oligonucleotide is described as the sense strand in Table 2, 3, 6, 7, 8, 9, 14, 15, 18 or 20, and the second oligonucleotide is described as the corresponding antisense strand of the sense strand from 2, 3, 6, 7, 8, 9, 14, 15, 18 or 20. As described elsewhere herein and as known in the art, the complementary sequences of a dsRNA can also be contained as self-complementary regions of a single nucleic acid molecule, as opposed to being on separate oligonucleotides.

The skilled person is well aware that dsRNAs having a duplex structure of between 20 and 23, but specifically 21, base pairs have been hailed as particularly effective in inducing RNA interference (Elbashir et al., EMBO 2001, 20:6877-6888). However, others have found that shorter or longer RNA duplex structures can be effective as well. In the embodiments described above, by virtue of the nature of the oligonucleotide sequences provided in Tables 2, 3, 6, 7, 8, 9, 14, 15, 18 and 20, dsRNAs described herein can include at least one strand of a length of minimally 21 nucleotides. It can be reasonably expected that shorter duplexes having one of the sequences of Table 2, 3, 6, 7, 8, 9, 14, 15, 18 or 20 minus only a few nucleotides on one or both ends may be similarly effective as compared to the dsRNAs described above. Hence, dsRNAs having a partial sequence of at least 15, 16, 17, 18, 19, 20, or more contiguous nucleotides from one of the sequences of Table 2, 3, 6, 7, 8, 9, 14, 15, 18 or 20, and differing in their ability to inhibit the expression of an ALAS1gene by not more than 5, 10, 15, 20, 25, or 30% inhibition from a dsRNA comprising the full sequence, are contemplated according to the invention.

In addition, the RNAs provided in Tables 2 and 3, as well as the RNAs provided in Tables 2, 3, 6, 7, 8, 9, 14, 15, 18 and 20, identify a site in an ALAS1 transcript that is susceptible to RISC-mediated cleavage. As such, the present invention further features iRNAs that target within one of such sequences. As used herein, an iRNA is said to target within a particular site of an RNA transcript if the iRNA promotes cleavage of the transcript anywhere within that particular site. Such an iRNA will generally include at least 15 contiguous nucleotides from one of the sequences provided in Tables 2, 3, 6, 7, 8, 9, 14, 15, 18 and 20 coupled to additional nucleotide sequences taken from the region contiguous to the selected sequence in an ALAS1gene.

While a target sequence is generally 15-30 nucleotides in length, there is wide variation in the suitability of particular sequences in this range for directing cleavage of any given target RNA. Various software packages and the guidelines set out herein provide guidance for the identification of optimal target sequences for any given gene target, but an empirical approach can also be taken in which a "window" or "mask" of a given size (as a non-limiting example, 21 nucleotides) is literally or figuratively (including, e.g., in silico) placed on the target RNA sequence to identify sequences in the size range that may serve as target sequences. By moving the sequence "window" progressively one nucleotide upstream or downstream of an initial target sequence location, the next potential target sequence can be identified, until the complete set of possible sequences is identified for any given target size selected. This process, coupled with systematic synthesis and testing of the identified sequences (using assays as described herein or as known in the art) to identify those sequences that perform optimally can identify those RNA sequences that, when targeted with an iRNA agent, mediate the best inhibition of target gene expression. Thus, while the sequences identified, for example, in Tables 2, 3, 6, 7, 8, 9, 14, 15, 18 and 20, represent effective target sequences, it is contemplated that further optimization of inhibition efficiency can be achieved by progressively "walking the window" one nucleotide upstream or downstream of the given sequences to identify sequences with equal or better inhibition characteristics.

Further, it is contemplated that for any sequence identified, e.g., in Tables 2, 3, 6, 7, 8, 9, 14, 15, 18 and 20, further optimization can be achieved by systematically either adding or removing nucleotides to generate longer or shorter sequences and testing those and sequences generated by walking a window of the longer or shorter size up or down the target RNA from that point. Again, coupling this approach to generating new candidate targets with testing for effectiveness of iRNAs based on those target sequences in an inhibition assay as known in the art or as described herein can lead to further improvements in the efficiency of inhibition. Further still, such optimized sequences can be adjusted by, e.g., the introduction of modified nucleotides as described herein or as known in the art, addition or changes in overhang, or other modifications as known in the art and/or discussed herein to further optimize the molecule (e.g., increasing serum stability or circulating half-life, increasing thermal stability, enhancing transmembrane delivery, targeting to a particular location or cell type, increasing interaction with silencing pathway enzymes, increasing release from endosomes, etc.) as an expression inhibitor.

An iRNA as described herein can contain one or more mismatches to the target sequence. In one embodiment, an iRNA as described herein contains no more than 3 mismatches. If the antisense strand of the iRNA contains mismatches to a target sequence, it is preferable that the area of mismatch not be located in the center of the region of complementarity. If the antisense strand of the iRNA contains mismatches to the target sequence, it is preferable that the mismatch be restricted to be within the last 5 nucleotides from either the 5' or 3' end of the region of complementarity. For example, for a 23 nucleotide iRNA agent RNA strand which is complementary to a region of an ALAS1 gene, the RNA strand generally does not contain any mismatch within the central 13 nucleotides. The methods described herein or methods known in the art can be used to determine whether an iRNA containing a mismatch to a target sequence is effective in inhibiting the expression of an ALAS1 gene. Consideration of the efficacy of iRNAs with mismatches in inhibiting expression of an ALAS1 gene is important, especially if the particular region of complementarity in an ALAS1 gene is known to have polymorphic sequence variation within the population.

In one embodiment, at least one end of a dsRNA has a single-stranded nucleotide overhang of 1 to 4, generally 1 or 2 nucleotides. dsRNAs having at least one nucleotide overhang have unexpectedly superior inhibitory properties relative to their blunt-ended counterparts. In yet another embodiment, the RNA of an iRNA, e.g., a dsRNA, is chemically modified to enhance stability or other beneficial characteristics. The nucleic acids featured in the invention may be synthesized and/or modified by methods well established in the art, such as those described in "Current protocols in nucleic acid chemistry," Beaucage, S. L. et al. (Edrs.), John Wiley & Sons, Inc., New York, N.Y., USA, which is hereby incorporated herein by reference. Modifications include, for example, (a) end modifications, e.g., 5' end modifications (phosphorylation, conjugation, inverted linkages, etc.) 3' end modifications (conjugation, DNA nucleotides, inverted linkages, etc.), (b) base modifications, e.g., replacement with stabilizing bases, destabilizing bases, or bases that base pair with an expanded repertoire of partners, removal of bases (abasic nucleotides), or conjugated bases, (c) sugar modifications (e.g., at the 2' position or 4' position) or replacement of the sugar, as well as (d) backbone modifications, including modification or replacement of the phosphodiester linkages. Specific examples of RNA compounds useful in this invention include, but are not limited to RNAs containing modified backbones or no natural internucleoside linkages. RNAs having modified backbones include, among others, those that do not have a phosphorus atom in the backbone. For the purposes of this specification, and as sometimes referenced in the art, modified RNAs that do not have a phosphorus atom in their internucleoside backbone can also be considered to be oligonucleosides. In particular embodiments, the modified RNA will have a phosphorus atom in its internucleoside backbone.

Modified RNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those) having inverted polarity wherein the adjacent pairs of nucleoside units are linked 3'-5' to 5'-3' or 2'-5' to 5'-2'. Various salts, mixed salts and free acid forms are also included.

Representative U.S. patents that teach the preparation of the above phosphorus-containing linkages include, but are not limited to, U.S. Pat. Nos. 3,687,808; 4,469,863; 4,476,301; 5,023,243; 5,177,195; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,316; 5,550,111; 5,563,253; 5,571,799; 5,587,361; 5,625,050; 6,028,188; 6,124,445; 6,160,109; 6,169,170; 6,172,209; 6,239,265; 6,277,603; 6,326,199; 6,346,614; 6,444,423; 6,531,590; 6,534,639; 6,608,035; 6,683,167; 6,858,715; 6,867,294; 6,878,805; 7,015,315; 7,041,816; 7,273,933; 7,321,029; and U.S. Pat. RE39464, each of which is herein incorporated by reference.

Modified RNA backbones that do not include a phosphorus atom therein have backbones that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts.

Representative U.S. patents that teach the preparation of the above oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and, 5,677,439, each of which is herein incorporated by reference.

In other RNA mimetics suitable or contemplated for use in iRNAs, both the sugar and the internucleoside linkage, i.e., the backbone, of the nucleotide units are replaced with novel groups. The base units are maintained for hybridization with an appropriate nucleic acid target compound. One such oligomeric compound, an RNA mimetic that has been shown to have excellent hybridization properties, is referred to as a peptide nucleic acid (PNA). In PNA compounds, the sugar backbone of an RNA is replaced with an amide containing backbone, in particular an aminoethylglycine backbone. The nucleobases are retained and are bound directly or indirectly to aza nitrogen atoms of the amide portion of the backbone. Representative U.S. patents that teach the preparation of PNA compounds include, but are not limited to, U.S. Pat. Nos. 5,539,082; 5,714,331; and 5,719,262, each of which is herein incorporated by reference. Further teaching of PNA compounds can be found, for example, in Nielsen et al., Science, 1991, 254, 1497-1500.

Some embodiments featured in the invention include RNAs with phosphorothioate backbones and oligonucleosides with heteroatom backbones, and in particular —$CH_2$—NH—$CH_2$—, —$CH_2$—N($CH_3$)—O—$CH_2$— [known as a methylene (methylimino) or MMI backbone], —$CH_2$—O—N($CH_3$)—$CH_2$—, —$CH_2$—N($CH_3$)—N($CH_3$)—$CH_2$— and —N($CH_3$)—$CH_2$—$CH_2$— [wherein the native phosphodiester backbone is represented as —O—P—O—$CH_2$—] of the above-referenced U.S. Pat. No. 5,489,677, and the amide backbones of the above-referenced U.S. Pat. No. 5,602,240. In some embodiments, the RNAs featured herein have morpholino backbone structures of the above-referenced U.S. Pat. No. 5,034,506.

Modified RNAs may also contain one or more substituted sugar moieties. The iRNAs, e.g., dsRNAs, featured herein can include one of the following at the 2' position: OH; F; O-, S-, or N-alkyl; O-, S-, or N-alkenyl; O-, S- or N-alkynyl; or O-alkyl-O-alkyl, wherein the alkyl, alkenyl and alkynyl may be substituted or unsubstituted $C_1$ to $C_{10}$ alkyl or $C_2$ to $C_{10}$ alkenyl and alkynyl. Exemplary suitable modifications include O[($CH_2$)$_n$O]$_m$$CH_3$, O($CH_2$)$_m$O$CH_3$, O($CH_2$)$_n$$NH_2$, O($CH_2$)$_n$$CH_3$, O($CH_2$)$_n$O$NH_2$, and O($CH_2$)$_n$ON[($CH_2$)$_n$$CH_3$)]$_2$, where n and m are from 1 to about 10. In other embodiments, dsRNAs include one of the following at the 2' position: $C_1$ to $C_{10}$ lower alkyl, substituted lower alkyl, alkaryl, aralkyl, O-alkaryl or O-aralkyl, SH, S$CH_3$, OCN, Cl, Br, CN, $CF_3$, O$CF_3$, SO$CH_3$, $SO_2$$CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an iRNA, or a group for improving the pharmacodynamic properties of an iRNA, and other substituents having similar properties. In some embodiments, the modification includes a 2'-methoxyethoxy (2'-O—$CH_2$$CH_2$O$CH_3$, also known as 2'-O-(2-methoxyethyl) or 2'-MOE) (Martin et al., Helv. Chim. Acta, 1995, 78:486-504) i.e., an alkoxy-alkoxy group. Another exemplary modification is 2'-dimethylaminooxyethoxy, i.e., a O($CH_2$)$_2$ON($CH_3$)$_2$ group, also known as 2'-DMAOE, as described in examples herein below, and 2'-dimethylaminoethoxyethoxy (also known in the art as 2'-O-dimethylaminoethoxyethyl or 2'-DMAEOE), i.e., 2'-O—$CH_2$—O—$CH_2$—N($CH_2$)$_2$, also described in examples herein below.

Other modifications include 2'-methoxy (2'-O$CH_3$), 2'-aminopropoxy (2'-O$CH_2$$CH_2$$CH_2$$NH_2$) and 2'-fluoro (2'-

F) Similar modifications may also be made at other positions on the RNA of an iRNA, particularly the 3' position of the sugar on the 3' terminal nucleotide or in 2'-5' linked dsRNAs and the 5' position of 5' terminal nucleotide. iRNAs may also have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application, and each of which is herein incorporated by reference.

An iRNA may also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C) and uracil (U). Modified nucleobases include other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine. Further nucleobases include those disclosed in U.S. Pat. No. 3,687,808, those disclosed in Modified Nucleosides in Biochemistry, Biotechnology and Medicine, Herdewijn, P. ed. Wiley-VCH, 2008; those disclosed in The Concise Encyclopedia Of Polymer Science And Engineering, pages 858-859, Kroschwitz, J. L, ed. John Wiley & Sons, 1990, these disclosed by Englisch et al., Angewandte Chemie, International Edition, 1991, 30, 613, and those disclosed by Sanghvi, Y S., Chapter 15, dsRNA Research and Applications, pages 289-302, Crooke, S. T. and Lebleu, B., Ed., CRC Press, 1993. Certain of these nucleobases are particularly useful for increasing the binding affinity of the oligomeric compounds featured in the invention. These include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., Eds., dsRNA Research and Applications, CRC Press, Boca Raton, 1993, pp. 276-278) and are exemplary base substitutions, even more particularly when combined with 2'-O-methoxyethyl sugar modifications.

Representative U.S. patents that teach the preparation of certain of the above noted modified nucleobases as well as other modified nucleobases include, but are not limited to, the above noted U.S. Pat. No. 3,687,808, as well as U.S. Pat. Nos. 4,845,205; 5,130,30; 5,134,066; 5,175,273; 5,367,066; 5,432,272; 5,457,187; 5,459,255; 5,484,908; 5,502,177; 5,525,711; 5,552,540; 5,587,469; 5,594,121; 5,596,091; 5,614,617; 5,681,941; 6,015,886; 6,147,200; 6,166,197; 6,222,025; 6,235,887; 6,380,368; 6,528,640; 6,639,062; 6,617,438; 7,045,610; 7,427,672; and 7,495,088, each of which is herein incorporated by reference, and U.S. Pat. No. 5,750,692, also herein incorporated by reference.

The RNA of an iRNA can also be modified to include one or more locked nucleic acids (LNA). A locked nucleic acid is a nucleotide having a modified ribose moiety in which the ribose moiety comprises an extra bridge connecting the 2' and 4' carbons. This structure effectively "locks" the ribose in the 3'-endo structural conformation. The addition of locked nucleic acids to siRNAs has been shown to increase siRNA stability in serum, and to reduce off-target effects (Elmen, J. et al., (2005) *Nucleic Acids Research* 33(1):439-447; Mook, O R. et al., (2007) *Mol Canc Ther* 6(3):833-843; Grunweller, A. et al., (2003) *Nucleic Acids Research* 31(12): 3185-3193).

Representative U.S. patents that teach the preparation of locked nucleic acid nucleotides include, but are not limited to, the following: U.S. Pat. Nos. 6,268,490; 6,670,461; 6,794,499; 6,998,484; 7,053,207; 7,084,125; and 7,399,845, each of which is herein incorporated by reference in its entirety.

Potentially stabilizing modifications to the ends of RNA molecules can include N-(acetylaminocaproyl)-4-hydroxyprolinol (Hyp-C6-NHAc), N-(caproyl-4-hydroxyprolinol (Hyp-C6), N-(acetyl-4-hydroxyprolinol (Hyp-NHAc), thymidine-2'-O-deoxythymidine (ether), N-(aminocaproyl)-4-hydroxyprolinol (Hyp-C6-amino), 2-docosanoyl-uridine-3"-phosphate, inverted base dT(idT) and others. Disclosure of this modification can be found in PCT Publication No. WO 2011/005861.

iRNA Motifs

In one embodiment, the sense strand sequence may be represented by formula (I):

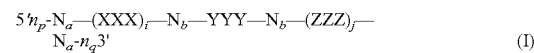

$$5'n_p\text{-}N_a\text{—}(XXX)_i\text{—}N_b\text{—}YYY\text{—}N_b\text{—}(ZZZ)_j\text{—}N_a\text{-}n_q3' \quad (I)$$

wherein:

i and j are each independently 0 or 1;

p and q are each independently 0-6;

each $N_a$ independently represents an oligonucleotide sequence comprising 0-25 modified nucleotides, each sequence comprising at least two differently modified nucleotides;

each $N_b$ independently represents an oligonucleotide sequence comprising 0-10 modified nucleotides;

each $n_p$ and $n_q$ independently represent an overhang nucleotide;

wherein Nb and Y do not have the same modification; and

XXX, YYY and ZZZ each independently represent one motif of three identical modifications on three consecutive nucleotides. Preferably YYY is all 2'-F modified nucleotides.

In one embodiment, the $N_a$ and/or $N_b$ comprise modifications of alternating pattern.

In one embodiment, the YYY motif occurs at or near the cleavage site of the sense strand. For example, when the RNAi agent has a duplex region of 17-23 nucleotides in length, the YYY motif can occur at or the vicinity of the cleavage site (e.g.: can occur at positions 6, 7, 8; 7, 8, 9; 8, 9, 10; 9, 10, 11; 10, 11, 12 or 11, 12, 13) of—the sense strand, the count starting from the 1$^{st}$ nucleotide, from the 5'-end; or optionally, the count starting at the 1$^{st}$ paired nucleotide within the duplex region, from the 5'-end.

In one embodiment, i is 1 and j is 0, or i is 0 and j is 1, or both i and j are 1. The sense strand can therefore be represented by the following formulas:

$$5'n_p\text{-}N_a\text{—}YYY\text{—}N_b\text{—}ZZZ\text{—}N_a\text{-}n_q3' \quad \text{(Ib);}$$

$$5'n_p\text{-}N_a\text{—}XXX\text{—}N_b\text{—}YYY\text{—}N_a\text{-}n_q3' \quad \text{(Ic); or}$$

$$5'n_p\text{-}N_a\text{—}XXX\text{—}N_b\text{—}YYY\text{—}N_b\text{—}ZZZ\text{—}N_a\text{-}n_q3' \quad \text{(Id).}$$

When the sense strand is represented by formula (Ib), $N_b$ represents an oligonucleotide sequence comprising 0-10, 0-7, 0-5, 0-4, 0-2 or 0 modified nucleotides. Each $N_a$ independently can represent an oligonucleotide sequence comprising 2-20, 2-15, or 2-10 modified nucleotides.

When the sense strand is represented as formula (Ic), $N_b$ represents an oligonucleotide sequence comprising 0-10, 0-7, 0-5, 0-4, 0-2 or 0 modified nucleotides. Each $N_a$ can independently represent an oligonucleotide sequence comprising 2-20, 2-15, or 2-10 modified nucleotides.

When the sense strand is represented as formula (Id), each $N_b$ independently represents an oligonucleotide sequence comprising 0-10, 0-7, 0-5, 0-4, 0-2 or 0 modified nucleotides. Preferably, $N_b$ is 0, 1, 2, 3, 4, 5 or 6. Each $N_a$ can independently represent an oligonucleotide sequence comprising 2-20, 2-15, or 2-10 modified nucleotides.

Each of X, Y and Z may be the same or different from each other.

In other embodiments, i is 0 and j is 0, and the sense strand may be represented by the formula:

$$5'n_p\text{-}N_a\text{—}YYY\text{—}N_a\text{-}n_q3' \quad \text{(Ia).}$$

When the sense strand is represented by formula (Ia), each $N_a$ independently can represent an oligonucleotide sequence comprising 2-20, 2-15, or 2-10 modified nucleotides.

In one embodiment, the antisense strand sequence of the RNAi may be represented by formula (II):

$$5'n_q\text{-}N'_a\text{—}(Z'Z'Z')_k\text{—}N'_b\text{—}Y'Y'Y'\text{—}N'_b\text{—}(X'X'X')_l\text{—}N'_a\text{-}n'_p3' \quad \text{(II)}$$

wherein:
k and l are each independently 0 or 1;
p' and q' are each independently 0-6;
each $N'_a$ independently represents an oligonucleotide sequence comprising 0-25 modified nucleotides, each sequence comprising at least two differently modified nucleotides;
each $N'_b$ independently represents an oligonucleotide sequence comprising 0-10 modified nucleotides;
each $n'_p$ and $n'_q$ independently represent an overhang nucleotide;
wherein $N'_b$ and Y' do not have the same modification; and
X'X'X', Y'Y'Y' and Z'Z'Z' each independently represent one motif of three identical modifications on three consecutive nucleotides.

In one embodiment, the $N'_a$ and/or $N'_b$ comprise modifications of alternating pattern.

The Y'Y'Y' motif occurs at or near the cleavage site of the antisense strand. For example, when the RNAi agent has a duplex region of 17-23 nucleotide in length, the Y'Y'Y' motif can occur at positions 9, 10, 11; 10, 11, 12; 11, 12, 13; 12, 13, 14; or 13, 14, 15 of the antisense strand, with the count starting from the 1st nucleotide, from the 5'-end; or optionally, the count starting at the 1st paired nucleotide within the duplex region, from the 5'-end. Preferably, the Y'Y'Y' motif occurs at positions 11, 12, 13.

In one embodiment, Y'Y'Y' motif is all 2'-OMe modified nucleotides.

In one embodiment, k is 1 and l is 0, or k is 0 and l is 1, or both k and l are 1.

The antisense strand can therefore be represented by the following formulas:

$$5'n_q\text{-}N'_a\text{—}Z'Z'Z'\text{—}N'_b\text{—}Y'Y'Y'\text{—}N'_a\text{-}n_p3' \quad \text{(IIb);}$$

$$5'n_q\text{-}N'_a\text{—}Y'Y'Y'\text{—}N'_b\text{—}X'X'X'\text{-}n_p3' \quad \text{(IIc); or}$$

$$5'n_q\text{-}N'_a\text{—}Z'Z'Z'\text{—}N'_b\text{—}Y'Y'Y'\text{—}N'_b\text{—}X'X'X'\text{—}N'_a\text{-}n_p3' \quad \text{(IId).}$$

When the antisense strand is represented by formula (IIb), $N'_b$ represents an oligonucleotide sequence comprising 0-10, 0-7, 0-5, 0-4, 0-2 or 0 modified nucleotides. Each $N'_a$ independently represents an oligonucleotide sequence comprising 2-20, 2-15, or 2-10 modified nucleotides.

When the antisense strand is represented as formula (IIc), $N'_b$ represents an oligonucleotide sequence comprising 0-10, 0-7, 0-5, 0-4, 0-2 or 0 modified nucleotides. Each $N'_a$ independently represents an oligonucleotide sequence comprising 2-20, 2-15, or 2-10 modified nucleotides.

When the antisense strand is represented as formula (IId), each $N'_b$ independently represents an oligonucleotide sequence comprising 0-10, 0-7, 0-5, 0-4, 0-2 or 0 modified nucleotides. Each $N'_a$ independently represents an oligonucleotide sequence comprising 2-20, 2-15, or 2-10 modified nucleotides. Preferably, $N_b$ is 0, 1, 2, 3, 4, 5 or 6.

In other embodiments, k is 0 and l is 0 and the antisense strand may be represented by the formula:

$$5'n_p\text{-}N_a\text{—}Y'Y'Y'\text{—}N_a\text{-}n_q3' \quad \text{(Ia).}$$

When the antisense strand is represented as formula (IIa), each $N'_a$ independently represents an oligonucleotide sequence comprising 2-20, 2-15, or 2-10 modified nucleotides.

Each of X', Y' and Z' may be the same or different from each other.

Each nucleotide of the sense strand and antisense strand may be independently modified with LNA, HNA, CeNA, 2'-methoxyethyl, 2'-O-methyl, 2'-O-allyl, 2'-C-allyl, 2'-hydroxyl, or 2'-fluoro. For example, each nucleotide of the sense strand and antisense strand is independently modified with 2'-O-methyl or 2'-fluoro. Each X, Y, Z, X', Y' and Z', in particular, may represent a 2'-O-methyl modification or a 2'-fluoro modification.

In one embodiment, the sense strand of the RNAi agent may contain YYY motif occurring at 9, 10 and 11 positions of the strand when the duplex region is 21 nt, the count starting from the 1st nucleotide from the 5'-end, or optionally, the count starting at the 1st paired nucleotide within the duplex region, from the 5'-end; and Y represents 2'-F modification. The sense strand may additionally contain XXX motif or ZZZ motifs as wing modifications at the opposite end of the duplex region; and XXX and ZZZ each independently represents a 2'-OMe modification or 2'-F modification.

In one embodiment the antisense strand may contain Y'Y'Y' motif occurring at positions 11, 12, 13 of the strand, the count starting from the 1st nucleotide from the 5'-end, or optionally, the count starting at the 1st paired nucleotide within the duplex region, from the 5'-end; and Y' represents 2'-O-methyl modification. The antisense strand may additionally contain X'X'X' motif or Z'Z'Z' motifs as wing modifications at the opposite end of the duplex region; and X'X'X' and Z'Z'Z' each independently represents a 2'-OMe modification or 2'-F modification.

The sense strand represented by any one of the above formulas (Ia), (Ib), (Ic), and (Id) forms a duplex with a antisense strand being represented by any one of formulas (IIa), (IIb), (IIc), and (IId), respectively.

Accordingly, the RNAi agents for use in the methods of the invention may comprise a sense strand and an antisense strand, each strand having 14 to 30 nucleotides, the RNAi duplex represented by formula (III):

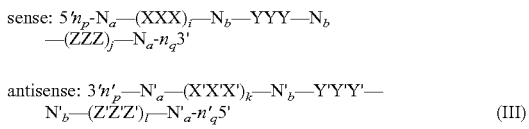

wherein:
i, j, k, and l are each independently 0 or 1;
p, p', q, and q' are each independently 0-6;
each $N_a$ and $N'_a$ independently represents an oligonucleotide sequence comprising 0-25 modified nucleotides, each sequence comprising at least two differently modified nucleotides;
each $N_b$ and $N'_b$ independently represents an oligonucleotide sequence comprising 0-10 modified nucleotides;
wherein
each $n'_p$, $n_p$, $n'_q$, and $n_q$, each of which may or may not be present, independently represents an overhang nucleotide; and
XXX, YYY, ZZZ, X'X'X', Y'Y'Y', and Z'Z'Z' each independently represent one motif of three identical modifications on three consecutive nucleotides.

In one embodiment, i is 0 and j is 0; or i is 1 and j is 0; or i is 0 and j is 1; or both i and j are 0; or both i and j are 1. In another embodiment, k is 0 and l is 0; or k is 1 and l is 0; k is 0 and l is 1; or both k and l are 0; or both k and l are 1.

Exemplary combinations of the sense strand and antisense strand forming a RNAi duplex include the formulas below:

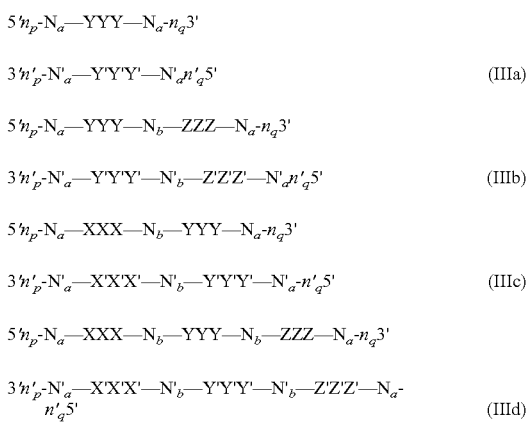

When the RNAi agent is represented by formula (IIIa), each $N_a$ independently represents an oligonucleotide sequence comprising 2-20, 2-15, or 2-10 modified nucleotides.

When the RNAi agent is represented by formula (IIIb), each $N_b$ independently represents an oligonucleotide sequence comprising 1-10, 1-7, 1-5 or 1-4 modified nucleotides. Each $N_a$ independently represents an oligonucleotide sequence comprising 2-20, 2-15, or 2-10 modified nucleotides.

When the RNAi agent is represented as formula (IIIc), each $N_b$, $N'_b$ independently represents an oligonucleotide sequence comprising 0-10, 0-7, 0-5, 0-4, 0-2 or 0 modified nucleotides. Each $N_a$ independently represents an oligonucleotide sequence comprising 2-20, 2-15, or 2-10 modified nucleotides.

When the RNAi agent is represented as formula (IIId), each $N_b$, $N'_b$ independently represents an oligonucleotide sequence comprising 0-10, 0-7, 0-5, 0-4, 0-2 or 0 modified nucleotides. Each $N_a$, $N'_a$ independently represents an oligonucleotide sequence comprising 2-20, 2-15, or 2-10 modified nucleotides. Each of $N_a$, $N'_a$, $N_b$ and $N'_b$ independently comprises modifications of alternating pattern.

Each of X, Y and Z in formulas (III), (IIIa), (IIIb), (IIIc), and (IIId) may be the same or different from each other.

When the RNAi agent is represented by formula (III), (IIIa), (IIIb), (IIIc), and (IIId), at least one of the Y nucleotides may form a base pair with one of the Y' nucleotides. Alternatively, at least two of the Y nucleotides form base pairs with the corresponding Y' nucleotides; or all three of the Y nucleotides all form base pairs with the corresponding Y' nucleotides.

When the RNAi agent is represented by formula (IIIb) or (IIId), at least one of the Z nucleotides may form a base pair with one of the Z' nucleotides. Alternatively, at least two of the Z nucleotides form base pairs with the corresponding Z' nucleotides; or all three of the Z nucleotides all form base pairs with the corresponding Z' nucleotides.

When the RNAi agent is represented as formula (IIIc) or (IIId), at least one of the X nucleotides may form a base pair with one of the X' nucleotides. Alternatively, at least two of the X nucleotides form base pairs with the corresponding X' nucleotides; or all three of the X nucleotides all form base pairs with the corresponding X' nucleotides.

In one embodiment, the modification on the Y nucleotide is different than the modification on the Y' nucleotide, the modification on the Z nucleotide is different than the modification on the Z' nucleotide, and/or the modification on the X nucleotide is different than the modification on the X' nucleotide.

In one embodiment, when the RNAi agent is represented by formula (IIId), the $N_a$ modifications are 2'-O-methyl or 2'-fluoro modifications. In another embodiment, when the RNAi agent is represented by formula (IIId), the $N_a$ modifications are 2'-O-methyl or 2'-fluoro modifications and $n'_p > 0$ and at least one $n'_p$ is linked to a neighboring nucleotide a via phosphorothioate linkage. In yet another embodiment, when the RNAi agent is represented by formula (IIId), the $N_a$ modifications are 2'-O-methyl or 2'-fluoro modifications, $n'_p > 0$ and at least one $n'_p$ is linked to a neighboring nucleotide via phosphorothioate linkage, and the sense strand is conjugated to one or more GalNAc derivatives attached through a bivalent or trivalent branched linker. In another embodiment, when the RNAi agent is represented by formula (IIId), the $N_a$ modifications are 2'-O-methyl or 2'-fluoro modifications, $n'_p > 0$ and at least one $n'_p$ is linked to a neighboring nucleotide via phosphorothioate linkage, the sense strand comprises at least one phosphorothioate linkage, and the sense strand is conjugated to one or more GalNAc derivatives attached through a bivalent or trivalent branched linker.

In one embodiment, when the RNAi agent is represented by formula (Ma), the $N_a$ modifications are 2'-O-methyl or 2'-fluoro modifications, $n'_p > 0$ and at least one $n'_p$ is linked to a neighboring nucleotide via phosphorothioate linkage, the sense strand comprises at least one phosphorothioate linkage, and the sense strand is conjugated to one or more GalNAc derivatives attached through a bivalent or trivalent branched linker.

In one embodiment, the RNAi agent is a multimer containing at least two duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, the RNAi agent is a multimer containing three, four, five, six or more duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, two RNAi agents represented by formula (III), (IIIa), (IIIb), (IIIc), and (IIId) are linked to each other at the 5' end, and one or both of the 3' ends and are optionally conjugated to to a ligand. Each of the agents can target the same gene or two different genes; or each of the agents can target same gene at two different target sites.

iRNA Conjugates

The iRNA agents disclosed herein can be in the form of conjugates. The conjugate may be attached at any suitable location in the iRNA molecule, e.g., at the 3' end or the 5' end of the sense or the antisense strand. The conjugates are optionally attached via a linker.

In some embodiments, an iRNA agent described herein is chemically linked to one or more ligands, moieties or conjugates, which may confer functionality, e.g., by affecting (e.g., enhancing) the activity, cellular distribution or cellular uptake of the iRNA. Such moieties include but are not limited to lipid moieties such as a cholesterol moiety (Letsinger et al., Proc. Natl. Acid. Sci. USA, 1989, 86: 6553-6556), cholic acid (Manoharan et al., Biorg. Med. Chem. Let., 1994, 4:1053-1060), a thioether, e.g., beryl-5-tritylthiol (Manoharan et al., Ann. N.Y. Acad. Sci., 1992, 660:306-309; Manoharan et al., Biorg. Med. Chem. Let., 1993, 3:2765-2770), a thiocholesterol (Oberhauser et al., Nucl. Acids Res., 1992, 20:533-538), an aliphatic chain, e.g., dodecandiol or undecyl residues (Saison-Behmoaras et al., EMBO J, 1991, 10:1111-1118; Kabanov et al., FEBS Lett., 1990, 259:327-330; Svinarchuk et al., Biochimie, 1993, 75:49-54), a phospholipid, e.g., di-hexadecyl-rac-glycerol or triethyl-ammonium 1,2-di-O-hexadecyl-rac-glycero-3-phosphonate (Manoharan et al., Tetrahedron Lett., 1995, 36:3651-3654; Shea et al., Nucl. Acids Res., 1990, 18:3777-3783), a polyamine or a polyethylene glycol chain (Manoharan et al., Nucleosides & Nucleotides, 1995, 14:969-973), or adamantane acetic acid (Manoharan et al., Tetrahedron Lett., 1995, 36:3651-3654), a palmityl moiety (Mishra et al., Biochim. Biophys. Acta, 1995, 1264:229-237), or an octadecylamine or hexylamino-carbonyloxycholesterol moiety (Crooke et al., J. Pharmacol. Exp. Ther., 1996, 277:923-937).

In one embodiment, a ligand alters the distribution, targeting or lifetime of an iRNA agent into which it is incorporated. In some embodiments, a ligand provides an enhanced affinity for a selected target, e.g, molecule, cell or cell type, compartment, e.g., a cellular or organ compartment, tissue, organ or region of the body, as, e.g., compared to a species absent such a ligand. Typical ligands will not take part in duplex pairing in a duplexed nucleic acid.

Ligands can include a naturally occurring substance, such as a protein (e.g., human serum albumin (HSA), low-density lipoprotein (LDL), or globulin); carbohydrate (e.g., a dextran, pullulan, chitin, chitosan, inulin, cyclodextrin or hyaluronic acid); or a lipid. The ligand may also be a recombinant or synthetic molecule, such as a synthetic polymer, e.g., a synthetic polyamino acid. Examples of polyamino acids include polyamino acid is a polylysine (PLL), poly L-aspartic acid, poly L-glutamic acid, styrene-maleic acid anhydride copolymer, poly(L-lactide-co-glycolide) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly(2-ethylacrylic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an α helical peptide.

Ligands can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetylgalactosamine, N-acetyl-gulucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, biotin, or an RGD peptide or RGD peptide mimetic.

In some embodiments, the ligand is a GalNAc ligand that comprises one or more N-acetylgalactosamine (GalNAc) derivatives. Additional description of GalNAc ligands is provided in the section titled Carbohydrate Conjugates.

Other examples of ligands include dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), lipophilic molecules, e.g, cholesterol, cholic acid, adamantane acetic acid, 1-pyrene butyric acid, dihydrotestosterone, 1,3-Bis-O (hexadecyl)glycerol, geranyloxyhexyl group, hexadecylglycerol, borneol, menthol, 1,3-propanediol, heptadecyl group, palmitic acid, myristic acid, O3-(oleoyl)lithocholic acid, O3-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, [MPEG]$_2$, polyamino, alkyl, substituted alkyl, radiolabeled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles), dinitrophenyl, HRP, or AP.

Ligands can be proteins, e.g., glycoproteins, or peptides, e.g., molecules having a specific affinity for a co-ligand, or antibodies e.g., an antibody, that binds to a specified cell type such as a cancer cell, endothelial cell, or bone cell. Ligands may also include hormones and hormone receptors. They can also include non-peptidic species, such as lipids, lectins, carbohydrates, vitamins, cofactors, multivalent lactose, multivalent galactose, N-acetyl-galactosamine, N-acetyl-gulucosamine multivalent mannose, or multivalent fucose. The ligand can be, for example, a lipopolysaccharide, an activator of p38 MAP kinase, or an activator of NF-κB.

The ligand can be a substance, e.g, a drug, which can increase the uptake of the iRNA agent into the cell, for example, by disrupting the cell's cytoskeleton, e.g., by disrupting the cell's microtubules, microfilaments, and/or intermediate filaments. The drug can be, for example, taxon, vincristine, vinblastine, cytochalasin, nocodazole, japlakinolide, latrunculin A, phalloidin, swinholide A, indanocine, or myoservin.

In some embodiments, a ligand attached to an iRNA as described herein acts as a pharmacokinetic modulator (PK modulator). PK modulators include lipophiles, bile acids, steroids, phospholipid analogues, peptides, protein binding agents, PEG, vitamins etc. Exemplary PK modulators include, but are not limited to, cholesterol, fatty acids, cholic acid, lithocholic acid, dialkylglycerides, diacylglyceride, phospholipids, sphingolipids, naproxen, ibuprofen, vitamin E, biotin etc. Oligonucleotides that comprise a number of phosphorothioate linkages are also known to bind to serum protein, thus short oligonucleotides, e.g., oligonucleotides of about 5 bases, 10 bases, 15 bases or 20 bases, comprising multiple of phosphorothioate linkages in the backbone are also amenable to the present invention as ligands (e.g. as PK modulating ligands). In addition, aptamers that bind serum components (e.g. serum proteins) are also suitable for use as PK modulating ligands in the embodiments described herein.

Ligand-conjugated oligonucleotides of the invention may be synthesized by the use of an oligonucleotide that bears a pendant reactive functionality, such as that derived from the attachment of a linking molecule onto the oligonucleotide (described below). This reactive oligonucleotide may be reacted directly with commercially-available ligands, ligands that are synthesized bearing any of a variety of protecting groups, or ligands that have a linking moiety attached thereto.

The oligonucleotides used in the conjugates of the present invention may be conveniently and routinely made through the well-known technique of solid-phase synthesis. Equipment for such synthesis is sold by several vendors including, for example, Applied Biosystems (Foster City, Calif.). Any other means for such synthesis known in the art may additionally or alternatively be employed. It is also known to use similar techniques to prepare other oligonucleotides, such as the phosphorothioates and alkylated derivatives.

In the ligand-conjugated oligonucleotides and ligand-molecule bearing sequence-specific linked nucleosides of the present invention, the oligonucleotides and oligonucleosides may be assembled on a suitable DNA synthesizer utilizing standard nucleotide or nucleoside precursors, or nucleotide or nucleoside conjugate precursors that already bear the linking moiety, ligand-nucleotide or nucleoside-conjugate precursors that already bear the ligand molecule, or non-nucleoside ligand-bearing building blocks.

When using nucleotide-conjugate precursors that already bear a linking moiety, the synthesis of the sequence-specific linked nucleosides is typically completed, and the ligand molecule is then reacted with the linking moiety to form the ligand-conjugated oligonucleotide. In some embodiments, the oligonucleotides or linked nucleosides of the present invention are synthesized by an automated synthesizer using phosphoramidites derived from ligand-nucleoside conjugates in addition to the standard phosphoramidites and non-standard phosphoramidites that are commercially available and routinely used in oligonucleotide synthesis.

Lipid Conjugates

In one embodiment, the ligand is a lipid or lipid-based molecule. Such a lipid or lipid-based molecule can typically bind a serum protein, such as human serum albumin (HSA). An HSA binding ligand allows for distribution of the conjugate to a target tissue, e.g., a non-kidney target tissue of the body. For example, the target tissue can be the liver, including parenchymal cells of the liver. Other molecules that can bind HSA can also be used as ligands. For example, neproxin or aspirin can be used. A lipid or lipid-based ligand can (a) increase resistance to degradation of the conjugate, (b) increase targeting or transport into a target cell or cell membrane, and/or (c) can be used to adjust binding to a serum protein, e.g., HSA.

A lipid based ligand can be used to modulate, e.g., control (e.g., inhibit) the binding of the conjugate to a target tissue. For example, a lipid or lipid-based ligand that binds to HSA more strongly will be less likely to be targeted to the kidney and therefore less likely to be cleared from the body. A lipid or lipid-based ligand that binds to HSA less strongly can be used to target the conjugate to the kidney.

In one embodiment, the lipid based ligand binds HSA. For example, the ligand can bind HSA with a sufficient affinity such that distribution of the conjugate to a non-kidney tissue is enhanced. However, the affinity is typically not so strong that the HSA-ligand binding cannot be reversed.

In another embodiment, the lipid based ligand binds HSA weakly or not at all, such that distribution of the conjugate to the kidney is enhanced. Other moieties that target to kidney cells can also be used in place of or in addition to the lipid based ligand.

In another aspect, the ligand is a moiety, e.g., a vitamin, which is taken up by a target cell, e.g., a proliferating cell. These are particularly useful for treating disorders characterized by unwanted cell proliferation, e.g., of the malignant or non-malignant type, e.g., cancer cells. Exemplary vitamins include vitamin A, E, and K. Other exemplary vitamins include are B vitamin, e.g., folic acid, B12, riboflavin, biotin, pyridoxal or other vitamins or nutrients taken up by cancer cells. Also included are HSA and low density lipoprotein (LDL).

Cell Permeation Agents

In another aspect, the ligand is a cell-permeation agent, such as a helical cell-permeation agent. In one embodiment, the agent is amphipathic. An exemplary agent is a peptide such as tat or antennopedia. If the agent is a peptide, it can be modified, including a peptidylmimetic, invertomers, non-peptide or pseudo-peptide linkages, and use of D-amino acids. The helical agent is typically an α-helical agent, and can have a lipophilic and a lipophobic phase.

The ligand can be a peptide or peptidomimetic. A peptidomimetic (also referred to herein as an oligopeptidomimetic) is a molecule capable of folding into a defined three-dimensional structure similar to a natural peptide. The attachment of peptide and peptidomimetics to iRNA agents can affect pharmacokinetic distribution of the iRNA, such as by enhancing cellular recognition and absorption. The peptide or peptidomimetic moiety can be about 5-50 amino acids long, e.g., about 5, 10, 15, 20, 25, 30, 35, 40, 45, or 50 amino acids long.

A peptide or peptidomimetic can be, for example, a cell permeation peptide, cationic peptide, amphipathic peptide, or hydrophobic peptide (e.g., consisting primarily of Tyr, Trp or Phe). The peptide moiety can be a dendrimer peptide, constrained peptide or crosslinked peptide. In another alternative, the peptide moiety can include a hydrophobic membrane translocation sequence (MTS). An exemplary hydrophobic MTS-containing peptide is RFGF having the amino acid sequence AAVALLPAVLLALLAP (SEQ ID NO:3367). An RFGF analogue (e.g., amino acid sequence AALLPV-LLAAP (SEQ ID NO:3368)) containing a hydrophobic MTS can also be a targeting moiety. The peptide moiety can be a "delivery" peptide, which can carry large polar molecules including peptides, oligonucleotides, and protein across cell membranes. For example, sequences from the HIV Tat protein (GRKKRRQRRRPPQ (SEQ ID NO:3369)) and the *Drosophila Antennapedia* protein (RQIKIWFQN-RRMKWKK (SEQ ID NO: 3370)) have been found to be capable of functioning as delivery peptides. A peptide or peptidomimetic can be encoded by a random sequence of DNA, such as a peptide identified from a phage-display library, or one-bead-one-compound (OBOC) combinatorial library (Lam et al., Nature, 354:82-84, 1991). Typically, the peptide or peptidomimetic tethered to a dsRNA agent via an incorporated monomer unit is a cell targeting peptide such as an arginine-glycine-aspartic acid (RGD)-peptide, or RGD mimic A peptide moiety can range in length from about 5 amino acids to about 40 amino acids. The peptide moieties can have a structural modification, such as to increase stability or direct conformational properties. Any of the structural modifications described below can be utilized.

An RGD peptide for use in the compositions and methods of the invention may be linear or cyclic, and may be modified, e.g., glycosylated or methylated, to facilitate targeting to a specific tissue(s). RGD-containing peptides and peptidiomimemtics may include D-amino acids, as well as synthetic RGD mimics. In addition to RGD, one can use other moieties that target the integrin ligand. Preferred conjugates of this ligand target PECAM-1 or VEGF.

An RGD peptide moiety can be used to target a particular cell type, e.g., a tumor cell, such as an endothelial tumor cell or a breast cancer tumor cell (Zitzmann et al., Cancer Res., 62:5139-43, 2002). An RGD peptide can facilitate targeting of an dsRNA agent to tumors of a variety of other tissues, including the lung, kidney, spleen, or liver (Aoki et al., Cancer Gene Therapy 8:783-787, 2001). Typically, the RGD peptide will facilitate targeting of an iRNA agent to the kidney. The RGD peptide can be linear or cyclic, and can be modified, e.g., glycosylated or methylated to facilitate targeting to specific tissues. For example, a glycosylated RGD peptide can deliver a iRNA agent to a tumor cell expressing $\alpha v\beta_3$ (Haubner et al., Jour. Nucl. Med., 42:326-336, 2001).

A "cell permeation peptide" is capable of permeating a cell, e.g., a microbial cell, such as a bacterial or fungal cell, or a mammalian cell, such as a human cell. A microbial cell-permeating peptide can be, for example, an α-helical linear peptide (e.g., LL-37 or Ceropin P1), a disulfide bond-containing peptide (e.g., α-defensin, β-defensin or bactenecin), or a peptide containing only one or two dominating amino acids (e.g., PR-39 or indolicidin). A cell permeation peptide can also include a nuclear localization signal (NLS). For example, a cell permeation peptide can be a bipartite amphipathic peptide, such as MPG, which is derived from the fusion peptide domain of HIV-1 gp41 and the NLS of SV40 large T antigen (Simeoni et al., Nucl. Acids Res. 31:2717-2724, 2003).

Carbohydrate Conjugates

In some embodiments of the compositions and methods of the invention, an iRNA oligonucleotide further comprises a carbohydrate. The carbohydrate conjugated iRNA are advantageous for the in vivo delivery of nucleic acids, as well as compositions suitable for in vivo therapeutic use, as described herein. As used herein, "carbohydrate" refers to a compound which is either a carbohydrate per se made up of one or more monosaccharide units having at least 6 carbon atoms (which can be linear, branched or cyclic) with an oxygen, nitrogen or sulfur atom bonded to each carbon atom; or a compound having as a part thereof a carbohydrate moiety made up of one or more monosaccharide units each having at least six carbon atoms (which can be linear, branched or cyclic), with an oxygen, nitrogen or sulfur atom bonded to each carbon atom. Representative carbohydrates include the sugars (mono-, di-, tri- and oligosaccharides containing from about 4, 5, 6, 7, 8, or 9 monosaccharide units), and polysaccharides such as starches, glycogen, cellulose and polysaccharide gums. Specific monosaccharides include C5 and above (e.g., C5, C6, C7, or C8) sugars; di- and trisaccharides include sugars having two or three monosaccharide units (e.g., C5, C6, C7, or C8).

In one embodiment, a carbohydrate conjugate comprises a monosaccharide. In one embodiment, the monosaccharide is an N-acetylgalactosamine (GalNAc). GalNAc conjugates are described, for example, in U.S. Pat. No. 8,106,022, the entire content of which is hereby incorporated herein by reference. In some embodiments, the GalNAc conjugate serves as a ligand that targets the iRNA to particular cells. In some embodiments, the GalNAc conjugate targets the iRNA to liver cells, e.g., by serving as a ligand for the asialoglycoprotein receptor of liver cells (e.g., hepatocytes).

In some embodiments, the carbohydrate conjugate comprises one or more GalNAc derivatives. The GalNAc derivatives may be attached via a linker, e.g., a bivalent or trivalent branched linker. In some embodiments the GalNAc conjugate is conjugated to the 3' end of the sense strand. In some embodiments, the GalNAc conjugate is conjugated to the iRNA agent (e.g., to the 3' end of the sense strand) via a linker, e.g., a linker as described herein.

In some embodiments, the GalNAc conjugate is

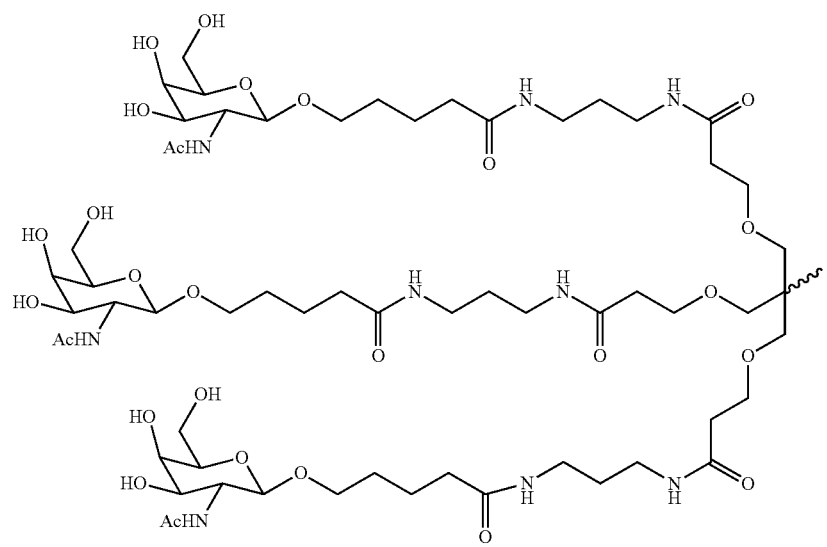

Formula II

In some embodiments, the RNAi agent is attached to the carbohydrate conjugate via a linker as shown in the following schematic, wherein X is O or S
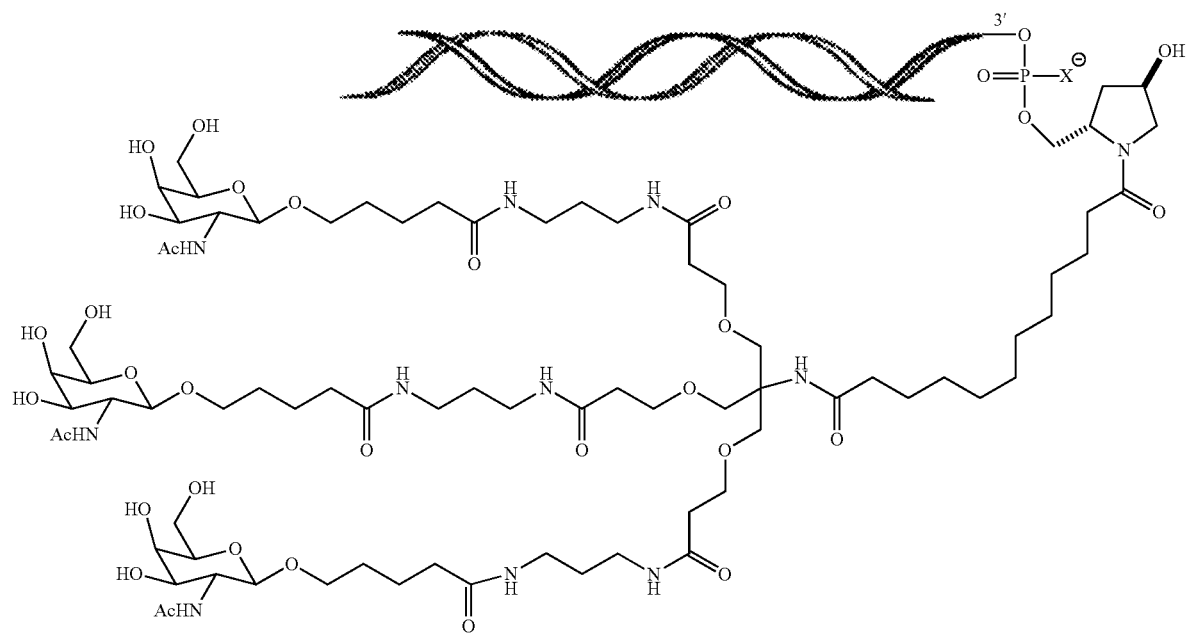
In some embodiments, the RNAi agent is conjugated to L96 as defined in Table 1 and shown below

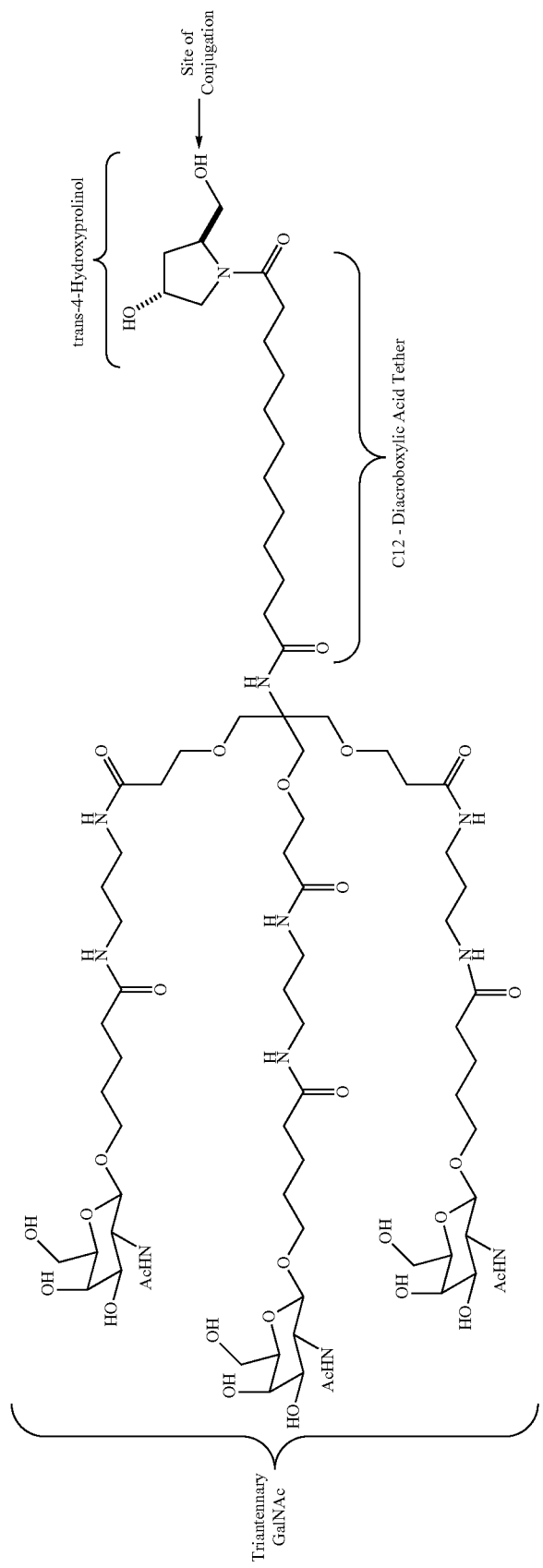

In some embodiments, a carbohydrate conjugate for use in the compositions and methods of the invention is selected from the group consisting of:
Formula II
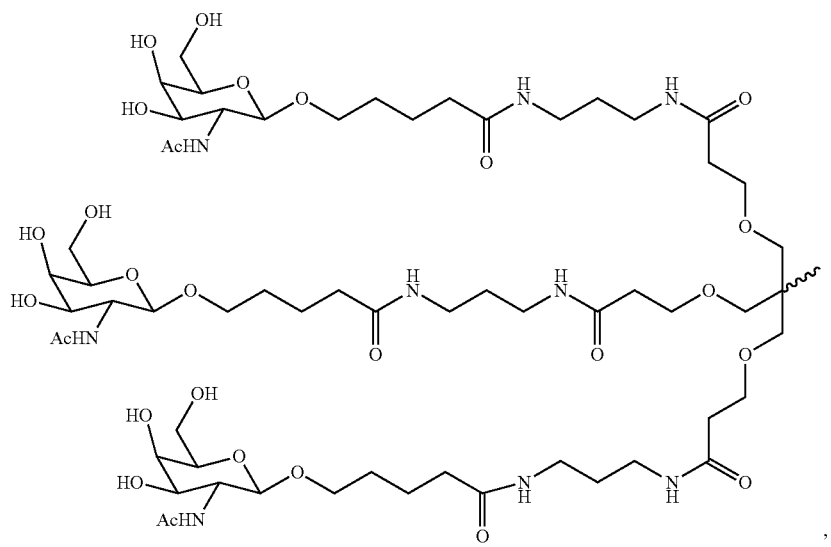 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]
Formula III
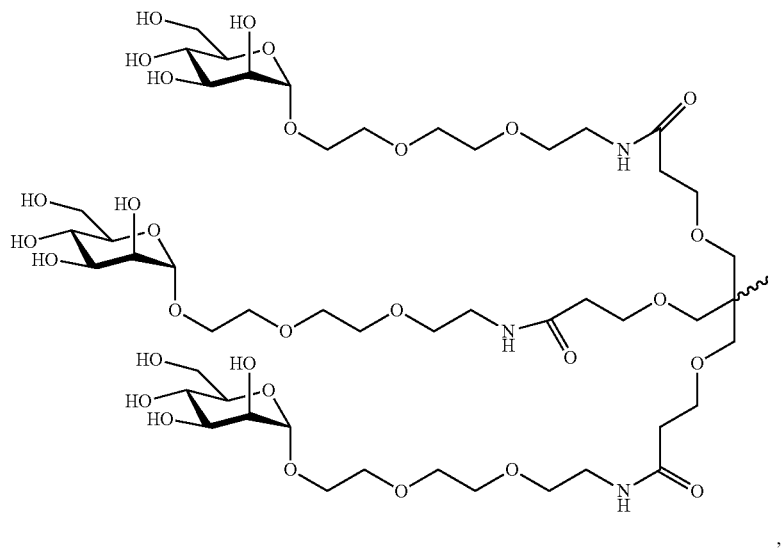
Formula IV
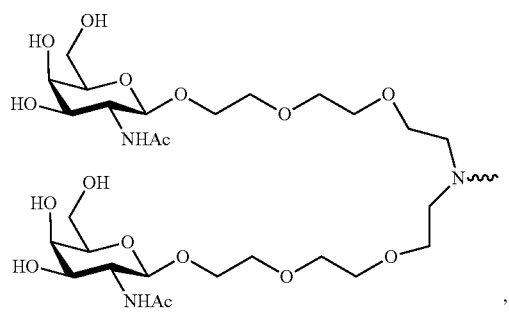
Formula V
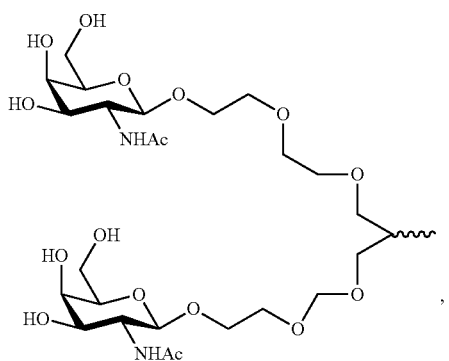

-continued
Formula VI
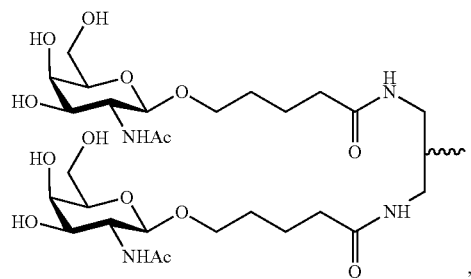
Formula VII
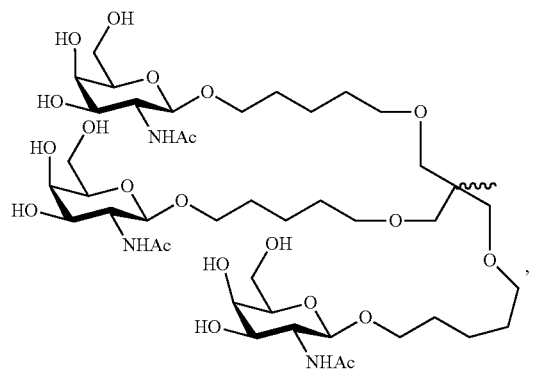
Formula VIII
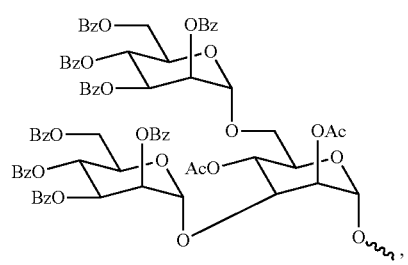
Formula IX
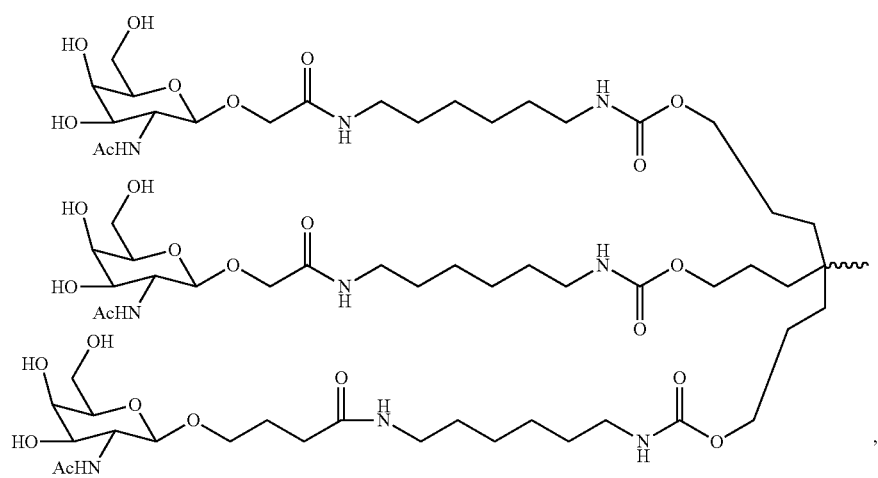
Formula X
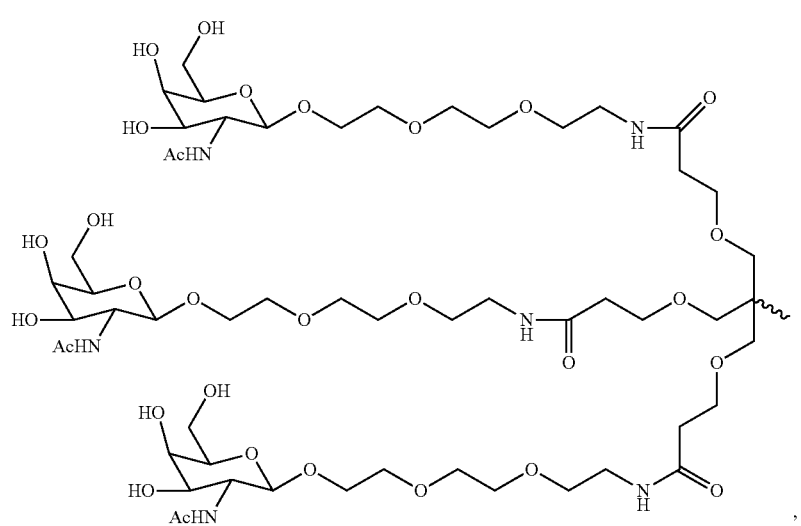

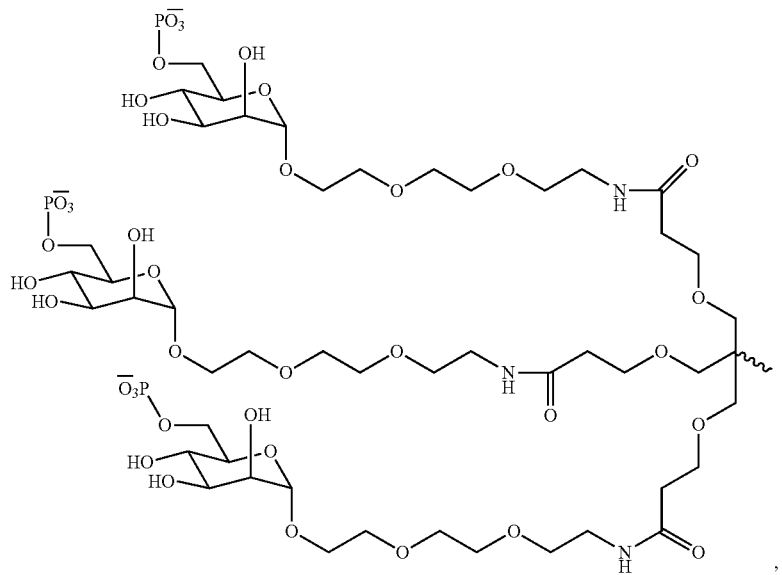
Formula XI
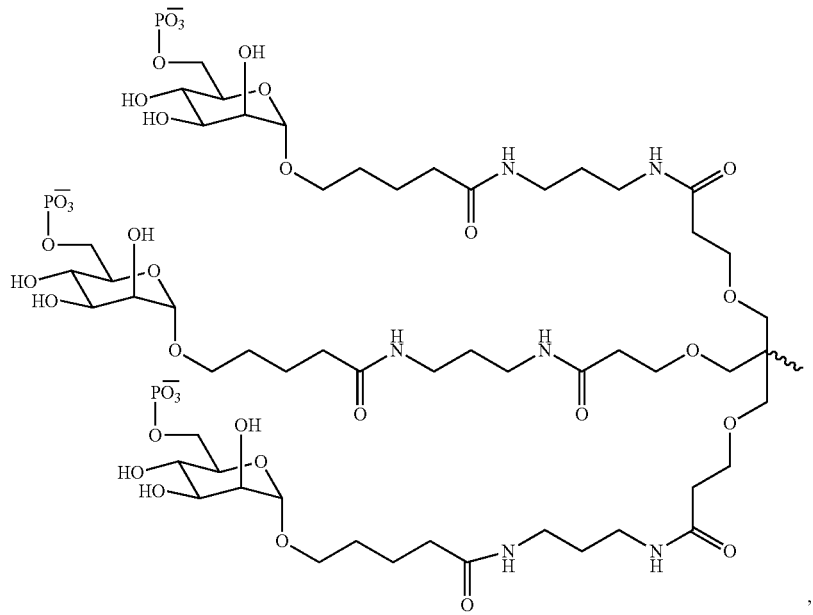
Formula XII
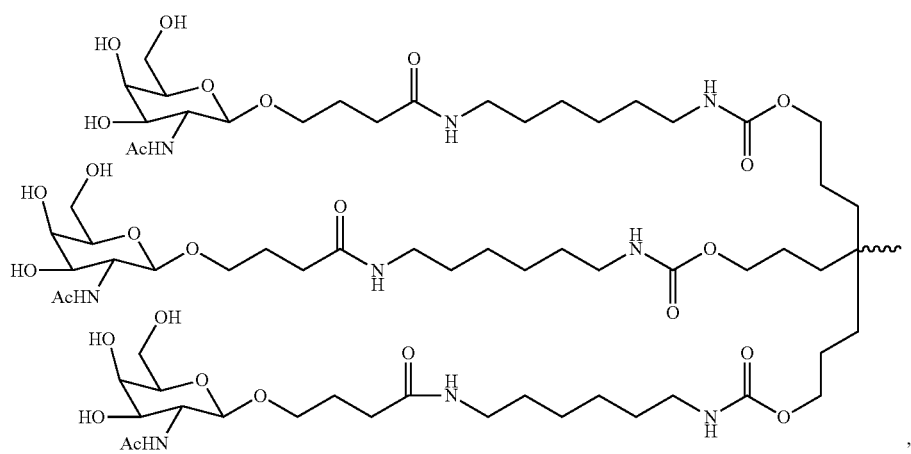
Formula XIII

-continued
Formula XIV
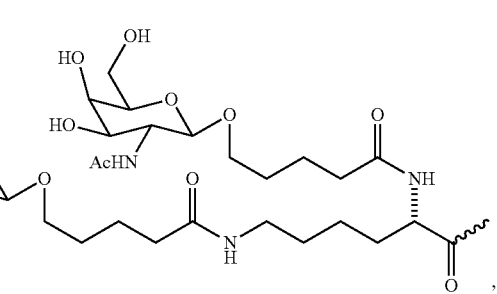
Formula XV
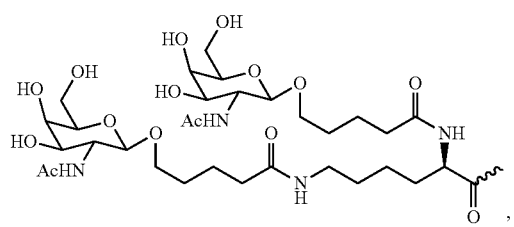
Formula XVI
Formula XVII
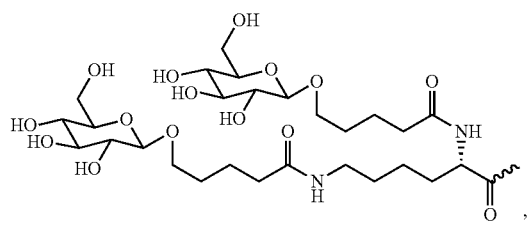
Formula XVIII
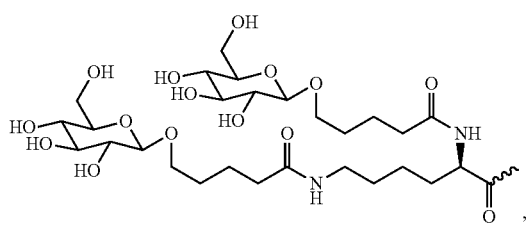
Formula XIX
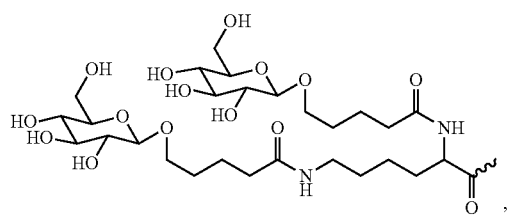
Formula XX
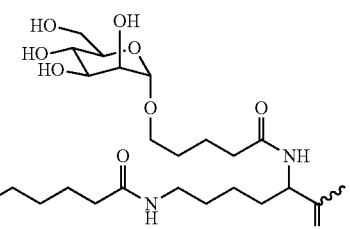
Formula XXI
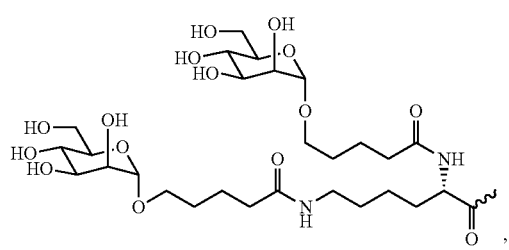
Formula XXII
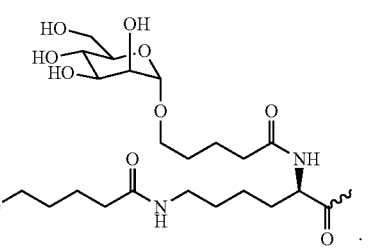
Another representative carbohydrate conjugate for use in the embodiments described herein includes, but is not limited to,

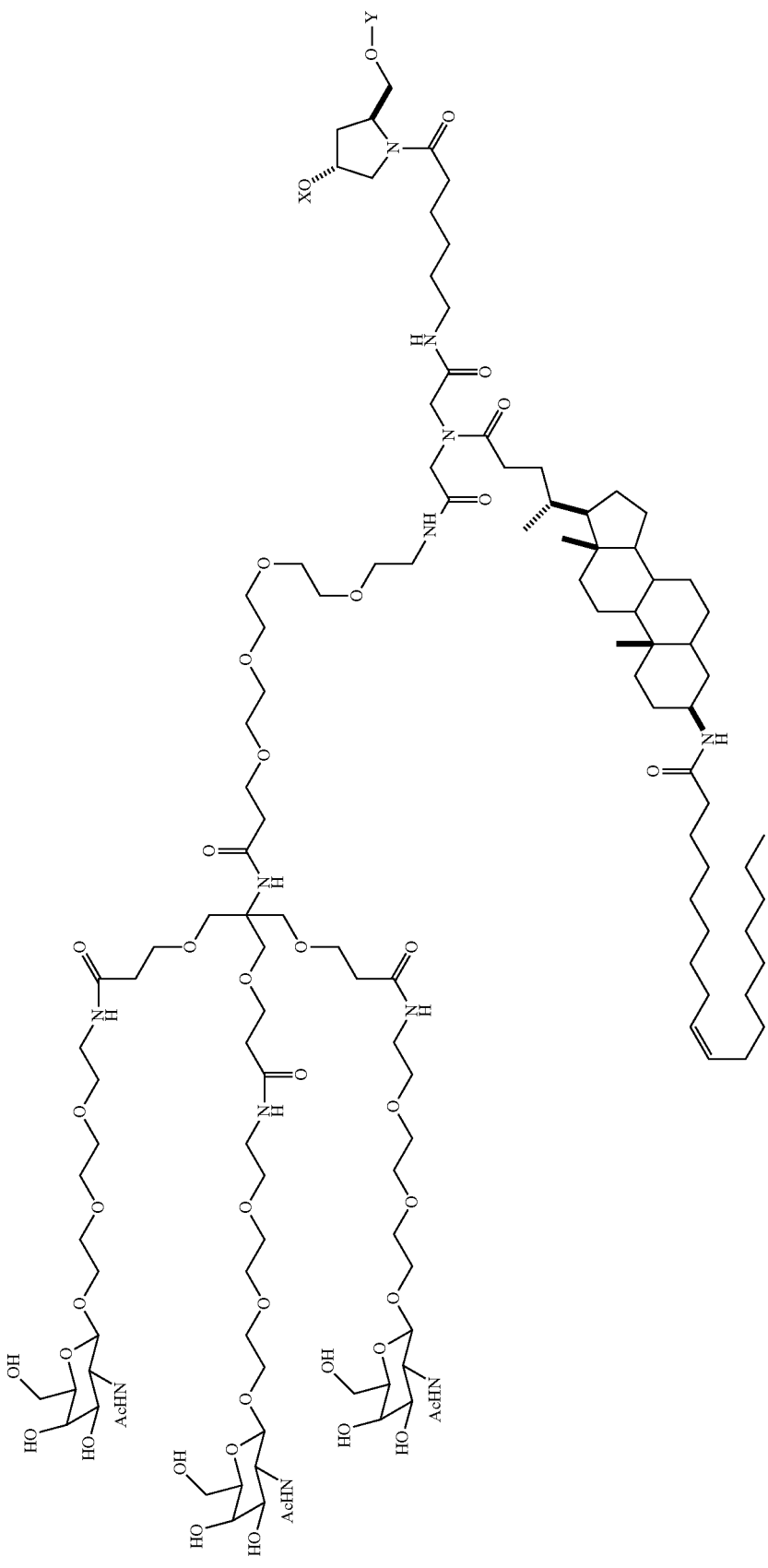

(Formula XXIII), when one of X or Y is an oligonucleotide, the other is a hydrogen.

In some embodiments, the carbohydrate conjugate further comprises one or more additional ligands as described above, such as, but not limited to, a PK modulator and/or a cell permeation peptide.

In one embodiment, an iRNA of the invention is conjugated to a carbohydrate through a linker Non-limiting examples of iRNA carbohydrate conjugates with linkers of the compositions and methods of the invention include, but are not limited to, (Formula XXIV)

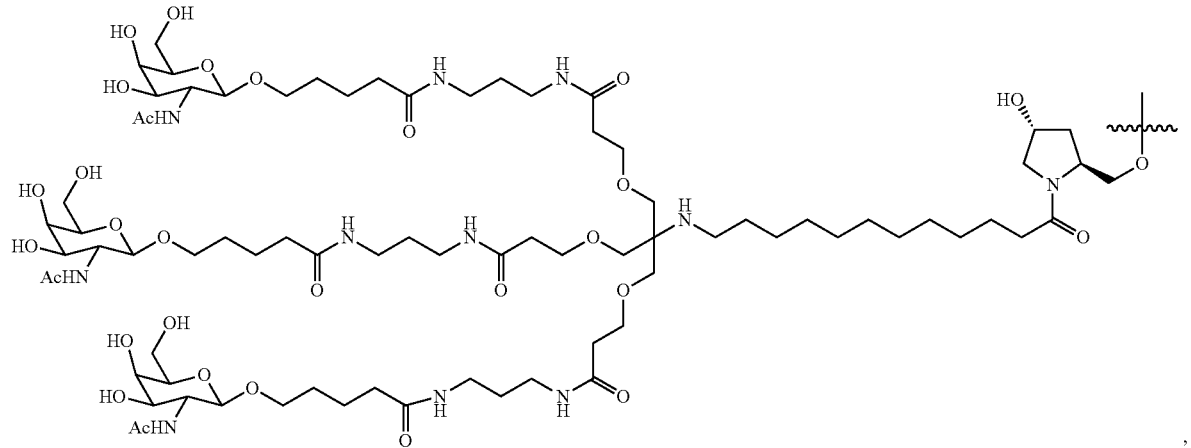

(Formula XXV)

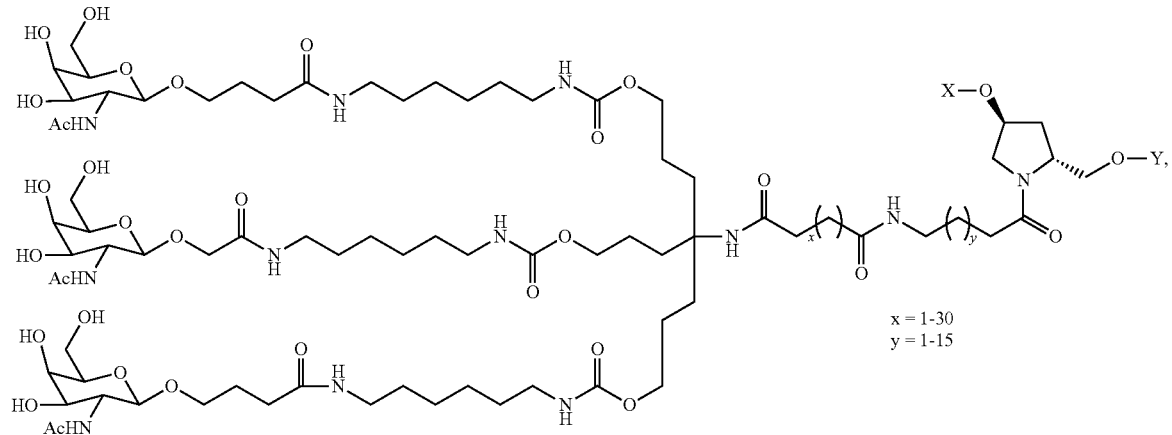

x = 1-30
y = 1-15

(Formula XXVI)

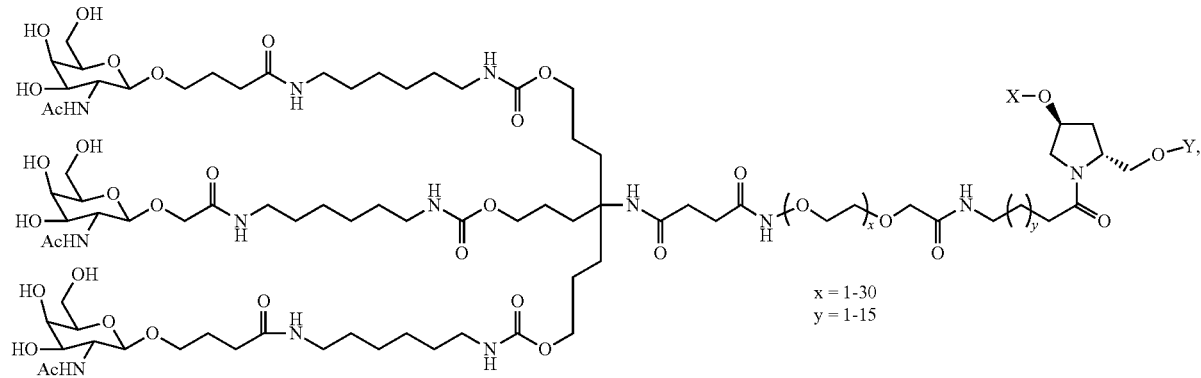

x = 1-30
y = 1-15

-continued
(Formula XXVII)
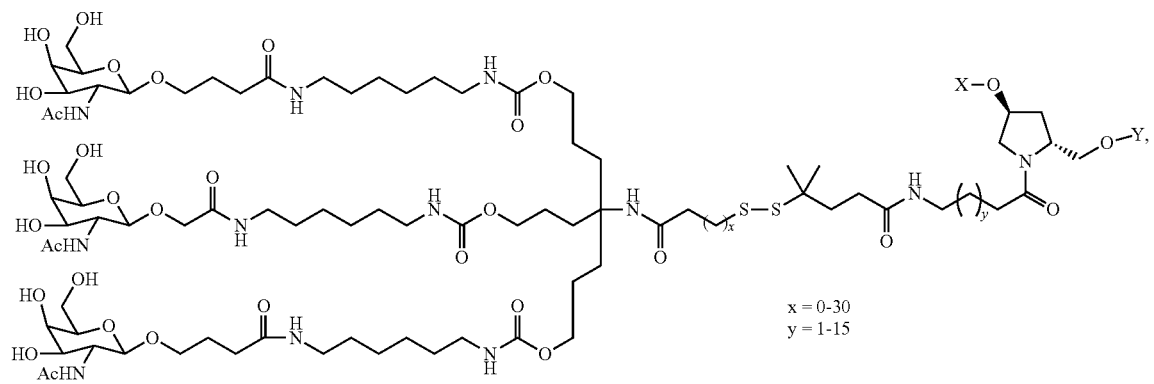
x = 0-30
y = 1-15
(Formula XXVIII)
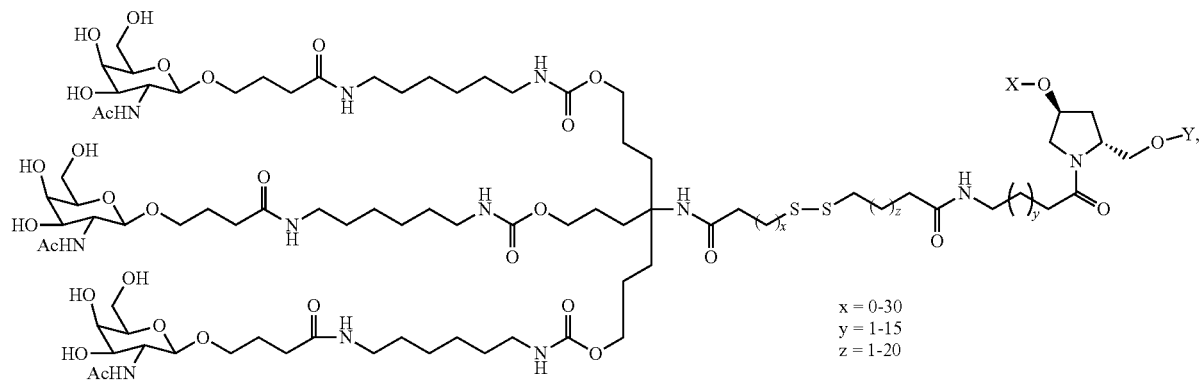
x = 0-30
y = 1-15
z = 1-20
(Formula XXIX)
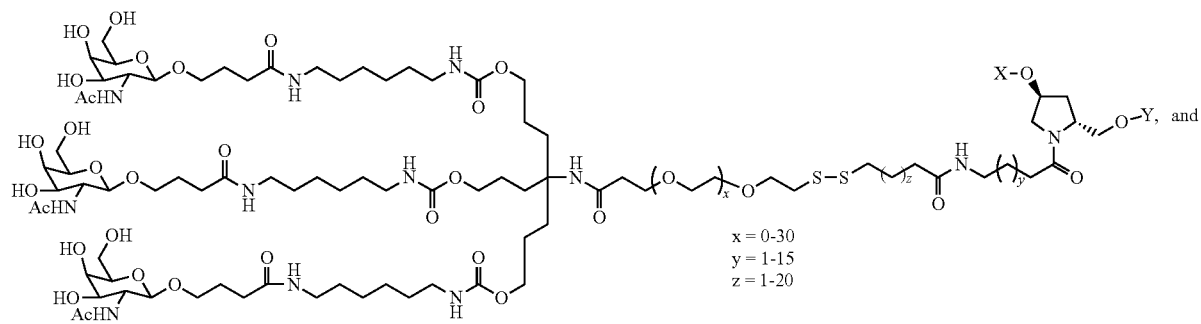
x = 0-30
y = 1-15
z = 1-20
(Formula XXX)
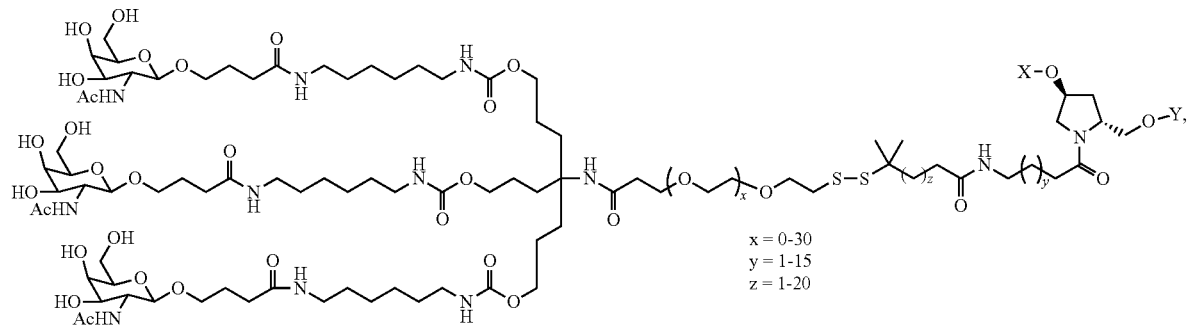
x = 0-30
y = 1-15
z = 1-20 when one of X or Y is an oligonucleotide, the other is a hydrogen.

Linkers

In some embodiments, the conjugate or ligand described herein can be attached to an iRNA oligonucleotide with various linkers that can be cleavable or non-cleavable.

The term "linker" or "linking group" means an organic moiety that connects two parts of a compound, e.g., covalently attaches two parts of a compound. Linkers typically comprise a direct bond or an atom such as oxygen or sulfur, a unit such as NR8, C(O), C(O)NH, SO, $SO_2$, $SO_2NH$ or a chain of atoms, such as, but not limited to, substituted or unsubstituted alkyl, substituted or unsubstituted alkenyl, substituted or unsubstituted alkynyl, arylalkyl, arylalkenyl, arylalkynyl, heteroarylalkyl, heteroarylalkenyl, heteroarylalkynyl, heterocyclylalkyl, heterocyclylalkenyl, heterocyclylalkynyl, aryl, heteroaryl, heterocyclyl, cycloalkyl, cycloalkenyl, alkylarylalkyl, alkylarylalkenyl, alkylarylalkynyl, alkenylarylalkyl, alkenylarylalkenyl, alkenylarylalkynyl, alkynylarylalkyl, alkynylarylalkenyl, alkynylarylalkynyl, alkylheteroarylalkyl, alkylheteroarylalkenyl, alkylheteroarylalkynyl, alkenylheteroarylalkyl, alkenylheteroarylalkenyl, alkenylheteroarylalkynyl, alkynylheteroarylalkyl, alkynylheteroarylalkenyl, alkynylheteroarylalkynyl, alkylheterocyclylalkyl, alkylheterocyclylalkenyl, alkylhererocyclylalkynyl, alkenylheterocyclylalkyl, alkenylheterocyclylalkenyl, alkenylheterocyclylalkynyl, alkynylheterocyclylalkyl, alkynylheterocyclylalkenyl, alkynylheterocyclylalkynyl, alkylaryl, alkenylaryl, alkynylaryl, alkylheteroaryl, alkenylheteroaryl, alkynylhereroaryl, which one or more methylenes can be interrupted or terminated by O, S, S(O), $SO_2$, N(R8), C(O), substituted or unsubstituted aryl, substituted or unsubstituted heteroaryl, substituted or unsubstituted heterocyclic; where R8 is hydrogen, acyl, aliphatic or substituted aliphatic. In one embodiment, the linker is between about 1-24 atoms, 2-24, 3-24, 4-24, 5-24, 6-24, 6-18, 7-18, 8-18 atoms, 7-17, 8-17, 6-16, 7-16, or 8-16 atoms.

In one embodiment, a dsRNA of the invention is conjugated to a bivalent or trivalent branched linker selected from the group of structures shown in any of formula (XXXI)-(XXXIV):

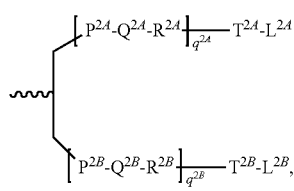

Formula XXXI

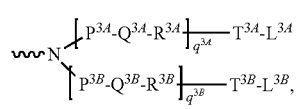

Formula XXXII

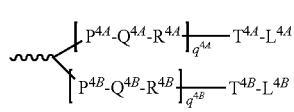

Formula XXXIII

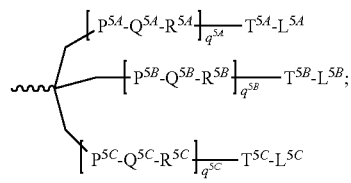

Formula XXXIV wherein:
q2A, q2B, q3A, q3B, q4A, q4B, q5A, q5B and q5C represent independently for each occurrence 0-20 and wherein the repeating unit can be the same or different;

$P^{2A}$, $P^{2B}$, $P^{3A}$, $P^{3B}$, $P^{4A}$, $P^{4B}$, $P^{5A}$, $P^{5B}$, $P^{5C}$, $T^{2A}$, $T^{2B}$, $T^{3A}$, $T^{3B}$, $T^{4A}$, $T^{4B}$, $T^{4A}$, $T^{5B}$, $T^{5C}$ are each independently for each occurrence absent, CO, NH, O, S, OC(O), NHC(O), $CH_2$, $CH_2NH$ or $CH_2O$;

$Q^{2A}$, $Q^{2B}$, $Q^{3A}$, $Q^{3B}$, $Q^{4A}$, $Q^{4B}$, $Q^{5A}$, $Q^{5B}$, $Q^{5C}$ are independently for each occurrence absent, alkylene, substituted alkylene wherein one or more methylenes can be interrupted or terminated by one or more of O, S, S(O), $SO_2$, $N(R^N)$, C(R')=C(R''), C≡C or C(O);

$R^{2A}$, $R^{2B}$, $R^{3A}$, $R^{3B}$, $R^{4A}$, $R^{4B}$, $R^{5A}$, $R^{5B}$, $R^{5C}$ are each independently for each occurrence absent, NH, O, S, $CH_2$, C(O)O, C(O)NH, $NHCH(R^a)C(O)$, —C(O)—$CH(R^a)$—NH—, CO, CH=N—O,

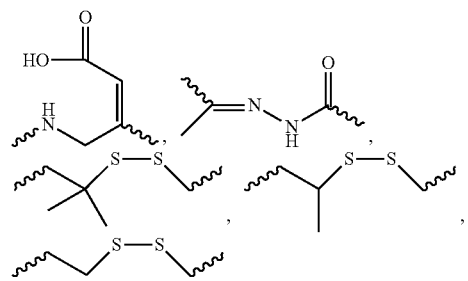

or heterocyclyl;

$L^{2A}$, $L^{2B}$, $L^{3A}$, $L^{3B}$, $L^{4A}$, $L^{4B}$, $L^{5A}$, $L^{5B}$ and $L^{5C}$ represent the ligand; i.e. each independently for each occurrence a monosaccharide (such as GalNAc), disaccharide, trisaccharide, tetrasaccharide, oligosaccharide, or polysaccharide; and $R^a$ is H or amino acid side chain. Trivalent conjugating GalNAc derivatives are particularly useful for use with RNAi agents for inhibiting the expression of a target gene, such as those of formula (XXXV):

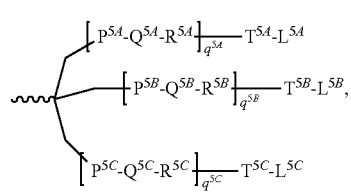

Formula XXXV wherein $L^{5A}$, $L^{5B}$ and $L^{5C}$ represent a monosaccharide, such as GalNAc derivative.

Examples of suitable bivalent and trivalent branched linker groups conjugating GalNAc derivatives include, but are not limited to, the structures recited above as formulas II, VII, XI, X, and XIII.

A cleavable linking group is one which is sufficiently stable outside the cell, but which upon entry into a target cell is cleaved to release the two parts the linker is holding together. In a preferred embodiment, the cleavable linking group is cleaved at least about 10 times, 20, times, 30 times, 40 times, 50 times, 60 times, 70 times, 80 times, 90 times or more, or at least about 100 times faster in a target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linking groups are susceptible to cleavage agents, e.g., pH, redox potential or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

A cleavable linkage group, such as a disulfide bond can be susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable linking group that is cleaved at a preferred pH, thereby releasing a cationic lipid from the ligand inside the cell, or into the desired compartment of the cell.

A linker can include a cleavable linking group that is cleavable by a particular enzyme. The type of cleavable linking group incorporated into a linker can depend on the cell to be targeted. For example, a liver-targeting ligand can be linked to a cationic lipid through a linker that includes an ester group. Liver cells are rich in esterases, and therefore the linker will be cleaved more efficiently in liver cells than in cell types that are not esterase-rich. Other cell-types rich in esterases include cells of the lung, renal cortex, and testis.

Linkers that contain peptide bonds can be used when targeting cell types rich in peptidases, such as liver cells and synoviocytes.

In general, the suitability of a candidate cleavable linking group can be evaluated by testing the ability of a degradative agent (or condition) to cleave the candidate linking group. It will also be desirable to also test the candidate cleavable linking group for the ability to resist cleavage in the blood or when in contact with other non-target tissue. Thus, one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It can be useful to make initial evaluations in cell-free or culture conditions and to confirm by further evaluations in whole animals. In preferred embodiments, useful candidate compounds are cleaved at least about 2, 4, 10, 20, 30, 40, 50, 60, 70, 80, 90, or about 100 times faster in the cell (or under in vitro conditions selected to mimic intracellular conditions) as compared to blood or serum (or under in vitro conditions selected to mimic extracellular conditions).

Redox Cleavable Linking Groups

In one embodiment, a cleavable linking group is a redox cleavable linking group that is cleaved upon reduction or oxidation. An example of reductively cleavable linking group is a disulphide linking group (—S—S—). To determine if a candidate cleavable linking group is a suitable "reductively cleavable linking group," or for example is suitable for use with a particular iRNA moiety and particular targeting agent one can look to methods described herein. For example, a candidate can be evaluated by incubation with dithiothreitol (DTT), or other reducing agent using reagents know in the art, which mimic the rate of cleavage which would be observed in a cell, e.g., a target cell. The candidates can also be evaluated under conditions which are selected to mimic blood or serum conditions. In one, candidate compounds are cleaved by at most about 10% in the blood. In other embodiments, useful candidate compounds are degraded at least about 2, 4, 10, 20, 30, 40, 50, 60, 70, 80, 90, or about 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

Phosphate-Based Cleavable Linking Groups

In another embodiment, a cleavable linker comprises a phosphate-based cleavable linking group. A phosphate-based cleavable linking group is cleaved by agents that degrade or hydrolyze the phosphate group. An example of an agent that cleaves phosphate groups in cells are enzymes such as phosphatases in cells. Examples of phosphate-based linking groups are —O—P(O)(ORk)-O—, —O—P(S)(ORk)-O—, —O—P(S)(SRk)-O—, —S—P(O)(ORk)-O—, —O—P(O)(ORk)-S—, —S—P(O)(ORk)-S—, —O—P(S)(ORk)-S—, —S—P(S)(ORk)-O—, —O—P(O)(Rk)-O—, —O—P(S)(Rk)-O—, —S—P(O)(Rk)-O—, —S—P(S)(Rk)-O—, —S—P(O)(Rk)-S—, —O—P(S)(Rk)-S—. Preferred embodiments are —O—P(O)(OH)—O—, —O—P(S)(OH)—O—, —O—P(S)(SH)—O—, —S—P(O)(OH)—O—, —O—P(O)(OH)—S—, —S—P(O)(OH)—S—, —O—P(S)(OH)—S—, —S—P(S)(OH)—O—, —O—P(O)(H)—O—, —O—P(S)(H)—O—, —S—P(O)(H)—O, —S—P(S)(H)—O—, —S—P(O)(H)—S—, —O—P(S)(H)—S—. A preferred embodiment is —O—P(O)(OH)—O—. These candidates can be evaluated using methods analogous to those described above.

Acid Cleavable Linking Groups

In another embodiment, a cleavable linker comprises an acid cleavable linking group. An acid cleavable linking group is a linking group that is cleaved under acidic conditions. In preferred embodiments acid cleavable linking groups are cleaved in an acidic environment with a pH of about 6.5 or lower (e.g., about 6.0, 5.75, 5.5, 5.25, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, esters, and esters of amino acids. Acid cleavable groups can have the general formula —C=NN—, C(O)O, or —OC(O). A preferred embodiment is when the carbon attached to the oxygen of the ester (the alkoxy group) is an aryl group, substituted alkyl group, or tertiary alkyl group such as dimethyl pentyl or t-butyl. These candidates can be evaluated using methods analogous to those described above.

Ester-Based Cleavable Linking Groups

In another embodiment, a cleavable linker comprises an ester-based cleavable linking group. An ester-based cleavable linking group is cleaved by enzymes such as esterases and amidases in cells. Examples of ester-based cleavable linking groups include but are not limited to esters of alkylene, alkenylene and alkynylene groups. Ester cleavable linking groups have the general formula —C(O)O—, or —OC(O)—. These candidates can be evaluated using methods analogous to those described above.

Peptide-Based Cleavable Linking Groups

In yet another embodiment, a cleavable linker comprises a peptide-based cleavable linking group. A peptide-based cleavable linking group is cleaved by enzymes such as peptidases and proteases in cells. Peptide-based cleavable linking groups are peptide bonds formed between amino acids to yield oligopeptides (e.g., dipeptides, tripeptides etc.) and polypeptides. Peptide-based cleavable groups do not include the amide group (—C(O)NH—). The amide group can be formed between any alkylene, alkenylene or alkynelene. A peptide bond is a special type of amide bond formed between amino acids to yield peptides and proteins. The peptide based cleavage group is generally limited to the peptide bond (i.e., the amide bond) formed between amino acids yielding peptides and proteins and does not include the entire amide functional group. Peptide-based cleavable linking groups have the general formula —NHCHRAC(O)NHCHRBC(O)— (SEQ ID NO: 13), where RA and RB are the R groups of the two adjacent amino acids. These candidates can be evaluated using methods analogous to those described above.

Representative U.S. patents that teach the preparation of RNA conjugates include, but are not limited to, U.S. Pat. Nos. 4,828,979; 4,948,882; 5,218,105; 5,525,465; 5,541,313; 5,545,730; 5,552,538; 5,578,717; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241; 5,391,723; 5,416,203; 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and U.S. Pat. Nos. 5,688,941; 6,294,664; 6,320,017; 6,576,752; 6,783,931; 6,900,297; 7,037,646; 8,106,022, the entire contents of each of which is herein incorporated by reference.

It is not necessary for all positions in a given compound to be uniformly modified, and in fact more than one of the aforementioned modifications may be incorporated in a single compound or even at a single nucleoside within an iRNA. The present invention also includes iRNA compounds that are chimeric compounds.

"Chimeric" iRNA compounds, or "chimeras," in the context of the present invention, are iRNA compounds, e.g., dsRNAs, that contain two or more chemically distinct regions, each made up of at least one monomer unit, i.e., a nucleotide in the case of a dsRNA compound. These iRNAs typically contain at least one region wherein the RNA is modified so as to confer upon the iRNA increased resistance to nuclease degradation, increased cellular uptake, and/or increased binding affinity for the target nucleic acid. An additional region of the iRNA may serve as a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of iRNA inhibition of gene expression. Consequently, comparable results can often be obtained with shorter iRNAs when chimeric dsRNAs are used, compared to phosphorothioate deoxy dsRNAs hybridizing to the same target region. Cleavage of the RNA target can be routinely detected by gel electrophoresis and, if necessary, associated nucleic acid hybridization techniques known in the art.

In certain instances, the RNA of an iRNA can be modified by a non-ligand group. A number of non-ligand molecules have been conjugated to iRNAs in order to enhance the activity, cellular distribution or cellular uptake of the iRNA, and procedures for performing such conjugations are available in the scientific literature. Such non-ligand moieties have included lipid moieties, such as cholesterol (Kubo, T. et al., Biochem. Biophys. Res. Comm., 2007, 365(1):54-61; Letsinger et al., Proc. Natl. Acad. Sci. USA, 1989, 86:6553), cholic acid (Manoharan et al., Bioorg. Med. Chem. Lett., 1994, 4:1053), a thioether, e.g., hexyl-S-tritylthiol (Manoharan et al., Ann. N.Y. Acad. Sci., 1992, 660:306; Manoharan et al., Bioorg. Med. Chem. Let., 1993, 3:2765), a thiocholesterol (Oberhauser et al., Nucl. Acids Res., 1992, 20:533), an aliphatic chain, e.g., dodecandiol or undecyl residues (Saison-Behmoaras et al., EMBO J., 1991, 10:111; Kabanov et al., FEBS Lett., 1990, 259:327; Svinarchuk et al., Biochimie, 1993, 75:49), a phospholipid, e.g., di-hexadecyl-rac-glycerol or triethylammonium 1,2-di-O-hexadecyl-rac-glycero-3-H-phosphonate (Manoharan et al., Tetrahedron Lett., 1995, 36:3651; Shea et al., Nucl. Acids Res., 1990, 18:3777), a polyamine or a polyethylene glycol chain (Manoharan et al., Nucleosides & Nucleotides, 1995, 14:969), or adamantane acetic acid (Manoharan et al., Tetrahedron Lett., 1995, 36:3651), a palmityl moiety (Mishra et al., Biochim. Biophys. Acta, 1995, 1264:229), or an octadecylamine or hexylamino-carbonyl-oxycholesterol moiety (Crooke et al., J. Pharmacol. Exp. Ther., 1996, 277:923). Representative United States patents that teach the preparation of such RNA conjugates have been listed above. Typical conjugation protocols involve the synthesis of an RNAs bearing an aminolinker at one or more positions of the sequence. The amino group is then reacted with the molecule being conjugated using appropriate coupling or activating reagents. The conjugation reaction may be performed either with the RNA still bound to the solid support or following cleavage of the RNA, in solution phase. Purification of the RNA conjugate by HPLC typically affords the pure conjugate.

Delivery of iRNA

The delivery of an iRNA to a subject in need thereof can be achieved in a number of different ways. In vivo delivery can be performed directly by administering a composition comprising an iRNA, e.g. a dsRNA, to a subject. Alternatively, delivery can be performed indirectly by administering one or more vectors that encode and direct the expression of the iRNA. These alternatives are discussed further below.

Direct Delivery

In general, any method of delivering a nucleic acid molecule can be adapted for use with an iRNA (see e.g., Akhtar S. and Julian R L. (1992) Trends Cell. Biol. 2(5): 139-144 and WO94/02595, which are incorporated herein by reference in their entireties). However, there are three factors that are important to consider in order to successfully deliver an iRNA molecule in vivo: (a) biological stability of the delivered molecule, (2) preventing non-specific effects, and (3) accumulation of the delivered molecule in the target tissue. The non-specific effects of an iRNA can be minimized by local administration, for example by direct injection or implantation into a tissue (as a non-limiting example, a tumor) or topically administering the preparation. Local administration to a treatment site maximizes local concentration of the agent, limits the exposure of the agent to systemic tissues that may otherwise be harmed by the agent or that may degrade the agent, and permits a lower total dose of the iRNA molecule to be administered. Several studies have shown successful knockdown of gene products when an iRNA is administered locally. For example, intraocular delivery of a VEGF dsRNA by intravitreal injection in cynomolgus monkeys (Tolentino, M J., et al (2004) Retina 24:132-138) and subretinal injections in mice (Reich, S J., et al (2003) Mol. Vis. 9:210-216) were both shown to prevent neovascularization in an experimental model of age-related macular degeneration. In addition, direct intratumoral injection of a dsRNA in mice reduces tumor volume (Pille, J., et al (2005) Mol. Ther. 11:267-274) and can prolong survival of tumor-bearing mice (Kim, W J., et al (2006) Mol. Ther. 14:343-350; Li, S., et al (2007) Mol. Ther. 15:515-523). RNA interference has also shown success with local delivery to the CNS by direct injection (Dorn, G., et al. (2004) Nucleic Acids 32:e49; Tan, P H., et al (2005) Gene Ther. 12:59-66; Makimura, H., et al (2002) BMC Neurosci. 3:18; Shishkina, G T., et al (2004) Neuroscience 129:521-528; Thakker, E R., et al (2004) Proc. Natl. Acad. Sci. U.S.A. 101:17270-17275; Akaneya, Y., et al (2005) J. Neurophysiol. 93:594-602) and to the lungs by intranasal administration (Howard, K A., et al (2006) Mol. Ther. 14:476-484; Zhang, X., et al (2004) J. Biol. Chem. 279:10677-10684; Bitko, V., et al (2005) Nat. Med. 11:50-55). For administering an iRNA systemically for the treatment of a disease, the RNA can be modified or alternatively delivered using a drug delivery system; both methods act to prevent the rapid degradation of the dsRNA by endo- and exo-nucleases in vivo.

Modification of the RNA or the pharmaceutical carrier can also permit targeting of the iRNA composition to the target tissue and avoid undesirable off-target effects. iRNA molecules can be modified by chemical conjugation to other groups, e.g., a lipid or carbohydrate group as described herein. Such conjugates can be used to target iRNA to particular cells, e.g., liver cells, e.g., hepatocytes. For example, GalNAc conjugates or lipid (e.g., LNP) formulations can be used to target iRNA to particular cells, e.g., liver cells, e.g., hepatocytes.

Lipophilic groups such as cholesterol to enhance cellular uptake and prevent degradation. For example, an iRNA directed against ApoB conjugated to a lipophilic cholesterol moiety was injected systemically into mice and resulted in knockdown of apoB mRNA in both the liver and jejunum (Soutschek, J., et al (2004) Nature 432:173-178). Conjugation of an iRNA to an aptamer has been shown to inhibit tumor growth and mediate tumor regression in a mouse model of prostate cancer (McNamara, J O., et al (2006) Nat. Biotechnol. 24:1005-1015). In an alternative embodiment, the iRNA can be delivered using drug delivery systems such as a nanoparticle, a dendrimer, a polymer, liposomes, or a cationic delivery system. Positively charged cationic delivery systems facilitate binding of an iRNA molecule (negatively charged) and also enhance interactions at the negatively charged cell membrane to permit efficient uptake of an iRNA by the cell. Cationic lipids, dendrimers, or polymers can either be bound to an iRNA, or induced to form a vesicle or micelle (see e.g., Kim S H., et al (2008) Journal of Controlled Release 129(2):107-116) that encases an iRNA. The formation of vesicles or micelles further prevents degradation of the iRNA when administered systemically. Methods for making and administering cationic-iRNA complexes are well within the abilities of one skilled in the art (see e.g., Sorensen, D R., et al (2003) J. Mol. Biol 327:761-766; Verma, U N., et al (2003) Clin. Cancer Res. 9:1291-1300; Arnold, A S et al (2007) J. Hypertens. 25:197-205, which are incorporated herein by reference in their entirety). Some non-limiting examples of drug delivery systems useful for systemic delivery of iRNAs include DOTAP (Sorensen, D R., et al (2003), supra; Verma, U N., et al (2003), supra), Oligofectamine, "solid nucleic acid lipid particles" (Zimmermann, T S., et al (2006) Nature 441:111-114), cardiolipin (Chien, P Y., et al (2005) Cancer Gene Ther. 12:321-328; Pal, A., et al (2005) Int J. Oncol. 26:1087-1091), polyethyleneimine (Bonnet M E., et al (2008) Pharm. Res. August 16 Epub ahead of print; Aigner, A. (2006) J. Biomed. Biotechnol. 71659), Arg-Gly-Asp (RGD) peptides (Liu, S. (2006) Mol. Pharm. 3:472-487), and polyamidoamines (Tomalia, D A., et al (2007) Biochem. Soc. Trans. 35:61-67; Yoo, H., et al (1999) Pharm. Res. 16:1799-1804). In some embodiments, an iRNA forms a complex with cyclodextrin for systemic administration. Methods for administration and pharmaceutical compositions of iRNAs and cyclodextrins can be found in U.S. Pat. No. 7,427,605, which is herein incorporated by reference in its entirety.

Vector Encoded iRNAs

In another aspect, iRNA targeting the ALAS1 gene can be expressed from transcription units inserted into DNA or RNA vectors (see, e.g., Couture, A, et al., TIG. (1996), 12:5-10; Skillern, A., et al., International PCT Publication No. WO 00/22113, Conrad, International PCT Publication No. WO 00/22114, and Conrad, U.S. Pat. No. 6,054,299). Expression can be transient (on the order of hours to weeks) or sustained (weeks to months or longer), depending upon the specific construct used and the target tissue or cell type. These transgenes can be introduced as a linear construct, a circular plasmid, or a viral vector, which can be an integrating or non-integrating vector. The transgene can also be constructed to permit it to be inherited as an extrachromosomal plasmid (Gassmann, et al., Proc. Natl. Acad. Sci. USA (1995) 92:1292).

The individual strand or strands of an iRNA can be transcribed from a promoter on an expression vector. Where two separate strands are to be expressed to generate, for example, a dsRNA, two separate expression vectors can be co-introduced (e.g., by transfection or infection) into a target cell. Alternatively each individual strand of a dsRNA can be transcribed by promoters both of which are located on the same expression plasmid. In one embodiment, a dsRNA is expressed as an inverted repeat joined by a linker polynucleotide sequence such that the dsRNA has a stem and loop structure.

An iRNA expression vector is typically a DNA plasmid or viral vector. An expression vector compatible with eukaryotic cells, e.g., with vertebrate cells, can be used to produce recombinant constructs for the expression of an iRNA as described herein. Eukaryotic cell expression vectors are well known in the art and are available from a number of commercial sources. Typically, such vectors contain convenient restriction sites for insertion of the desired nucleic acid segment. Delivery of iRNA expressing vectors can be systemic, such as by intravenous or intramuscular administration, by administration to target cells ex-planted from the patient followed by reintroduction into the patient, or by any other means that allows for introduction into a desired target cell.

An iRNA expression plasmid can be transfected into a target cell as a complex with a cationic lipid carrier (e.g., Oligofectamine) or a non-cationic lipid-based carrier (e.g., Transit-TKO™). Multiple lipid transfections for iRNA-mediated knockdowns targeting different regions of a target RNA over a period of a week or more are also contemplated by the invention. Successful introduction of vectors into host cells can be monitored using various known methods. For example, transient transfection can be signaled with a reporter, such as a fluorescent marker, such as Green Fluorescent Protein (GFP). Stable transfection of cells ex vivo can be ensured using markers that provide the transfected cell with resistance to specific environmental factors (e.g., antibiotics and drugs), such as hygromycin B resistance.

Viral vector systems which can be utilized with the methods and compositions described herein include, but are not limited to, (a) adenovirus vectors; (b) retrovirus vectors, including but not limited to lentiviral vectors, moloney murine leukemia virus, etc.; (c) adeno-associated virus vectors; (d) herpes simplex virus vectors; (e) SV40 vectors; (f) polyoma virus vectors; (g) papilloma virus vectors; (h) picornavirus vectors; (i) pox virus vectors such as an orthopox, e.g., vaccinia virus vectors or avipox, e.g. canary pox or fowl pox; and (j) a helper-dependent or gutless adenovirus. Replication-defective viruses can also be advantageous. Different vectors will or will not become incorporated into the cells' genome. The constructs can include viral sequences for transfection, if desired. Alternatively, the construct may be incorporated into vectors capable of episomal replication, e.g EPV and EBV vectors. Constructs for the recombinant expression of an iRNA will generally require regulatory elements, e.g., promoters, enhancers, etc., to ensure the expression of the iRNA in target cells. Other aspects to consider for vectors and constructs are further described below.

Vectors useful for the delivery of an iRNA will include regulatory elements (promoter, enhancer, etc.) sufficient for expression of the iRNA in the desired target cell or tissue. The regulatory elements can be chosen to provide either constitutive or regulated/inducible expression.

Expression of the iRNA can be precisely regulated, for example, by using an inducible regulatory sequence that is sensitive to certain physiological regulators, e.g., circulating glucose levels, or hormones (Docherty et al., 1994, FASEB J. 8:20-24). Such inducible expression systems, suitable for the control of dsRNA expression in cells or in mammals include, for example, regulation by ecdysone, by estrogen, progesterone, tetracycline, chemical inducers of dimerization, and isopropyl-β-D1-thiogalactopyranoside (IPTG). A person skilled in the art would be able to choose the appropriate regulatory/promoter sequence based on the intended use of the iRNA transgene.

In a specific embodiment, viral vectors that contain nucleic acid sequences encoding an iRNA can be used. For example, a retroviral vector can be used (see Miller et al., Meth. Enzymol. 217:581-599 (1993)). These retroviral vectors contain the components necessary for the correct packaging of the viral genome and integration into the host cell DNA. The nucleic acid sequences encoding an iRNA are cloned into one or more vectors, which facilitates delivery of the nucleic acid into a patient. More detail about retroviral vectors can be found, for example, in Boesen et al., Biotherapy 6:291-302 (1994), which describes the use of a retroviral vector to deliver the mdr1 gene to hematopoietic stem cells in order to make the stem cells more resistant to chemotherapy. Other references illustrating the use of retroviral vectors in gene therapy are: Clowes et al., J. Clin. Invest. 93:644-651 (1994); Kiem et al., Blood 83:1467-1473 (1994); Salmons and Gunzberg, Human Gene Therapy 4:129-141 (1993); and Grossman and Wilson, Curr. Opin. in Genetics and Devel. 3:110-114 (1993). Lentiviral vectors contemplated for use include, for example, the HIV based vectors described in U.S. Pat. Nos. 6,143,520; 5,665,557; and 5,981,276, which are herein incorporated by reference.

Adenoviruses are also contemplated for use in delivery of iRNAs. Adenoviruses are especially attractive vehicles, e.g., for delivering genes to respiratory epithelia. Adenoviruses naturally infect respiratory epithelia where they cause a mild disease. Other targets for adenovirus-based delivery systems are liver, the central nervous system, endothelial cells, and muscle. Adenoviruses have the advantage of being capable of infecting non-dividing cells. Kozarsky and Wilson, Current Opinion in Genetics and Development 3:499-503 (1993) present a review of adenovirus-based gene therapy. Bout et al., Human Gene Therapy 5:3-10 (1994) demonstrated the use of adenovirus vectors to transfer genes to the respiratory epithelia of rhesus monkeys. Other instances of the use of adenoviruses in gene therapy can be found in Rosenfeld et al., Science 252:431-434 (1991); Rosenfeld et al., Cell 68:143-155 (1992); Mastrangeli et al., J. Clin. Invest. 91:225-234 (1993); PCT Publication WO94/12649; and Wang, et al., Gene Therapy 2:775-783 (1995). A suitable AV vector for expressing an iRNA featured in the invention, a method for constructing the recombinant AV vector, and a method for delivering the vector into target cells, are described in Xia H et al. (2002), Nat. Biotech. 20: 1006-1010.

Use of Adeno-associated virus (AAV) vectors is also contemplated (Walsh et al., Proc. Soc. Exp. Biol. Med. 204:289-300 (1993); U.S. Pat. No. 5,436,146). In one embodiment, the iRNA can be expressed as two separate, complementary single-stranded RNA molecules from a recombinant AAV vector having, for example, either the U6 or H1 RNA promoters, or the cytomegalovirus (CMV) promoter. Suitable AAV vectors for expressing the dsRNA featured in the invention, methods for constructing the recombinant AV vector, and methods for delivering the vectors into target cells are described in Samulski R et al. (1987), J. Virol. 61: 3096-3101; Fisher K J et al. (1996), J. Virol, 70: 520-532; Samulski R et al. (1989), J. Virol. 63: 3822-3826; U.S. Pat. No. 5,252,479; U.S. Pat. No. 5,139,941; International Patent Application No. WO 94/13788; and International Patent Application No. WO 93/24641, the entire disclosures of which are herein incorporated by reference.

Another typical viral vector is a pox virus such as a vaccinia virus, for example an attenuated vaccinia such as Modified Virus Ankara (MVA) or NYVAC, an avipox such as fowl pox or canary pox.

The tropism of viral vectors can be modified by pseudotyping the vectors with envelope proteins or other surface antigens from other viruses, or by substituting different viral capsid proteins, as appropriate. For example, lentiviral vectors can be pseudotyped with surface proteins from vesicular stomatitis virus (VSV), rabies, Ebola, Mokola, and the like. AAV vectors can be made to target different cells by engineering the vectors to express different capsid protein serotypes; see, e.g., Rabinowitz J E et al. (2002), J Virol 76:791-801, the entire disclosure of which is herein incorporated by reference.

The pharmaceutical preparation of a vector can include the vector in an acceptable diluent, or can include a slow release matrix in which the gene delivery vehicle is imbedded. Alternatively, where the complete gene delivery vector can be produced intact from recombinant cells, e.g., retroviral vectors, the pharmaceutical preparation can include one or more cells which produce the gene delivery system.

III. Pharmaceutical Compositions Containing iRNA

In one embodiment, the invention provides pharmaceutical compositions containing an iRNA, as described herein, and a pharmaceutically acceptable carrier. The pharmaceutical composition containing the iRNA is useful for treating a disease or disorder related to the expression or activity of an ALAS1 gene (e.g., a disorder involving the porphyrin pathway). Such pharmaceutical compositions are formulated based on the mode of delivery. For example, compositions can be formulated for systemic administration via parenteral delivery, e.g., by intravenous (IV) delivery. In some embodiments, a composition provided herein (e.g., an LNP formulation) is formulated for intravenous delivery. In some embodiments, a composition provided herein (e.g., a composition comprising a GalNAc conjugate) is formulated for subcutaneous delivery.

The pharmaceutical compositions featured herein are administered in a dosage sufficient to inhibit expression of an ALAS1 gene. In general, a suitable dose of iRNA will be in the range of 0.01 to 200.0 milligrams per kilogram body weight of the recipient per day, generally in the range of 1 to 50 mg per kilogram body weight per day. For example, the dsRNA can be administered at 0.05 mg/kg, 0.5 mg/kg, 1 mg/kg, 1.5 mg/kg, 2 mg/kg, 3 mg/kg, 10 mg/kg, 20 mg/kg, 30 mg/kg, 40 mg/kg, or 50 mg/kg per single dose. The pharmaceutical composition may be administered once daily, or the iRNA may be administered as two, three, or more sub-doses at appropriate intervals throughout the day or even using continuous infusion or delivery through a controlled release formulation. In that case, the iRNA contained in each sub-dose must be correspondingly smaller in order to achieve the total daily dosage. The dosage unit can also be compounded for delivery over several days, e.g., using a conventional sustained release formulation which provides sustained release of the iRNA over a several day period. Sustained release formulations are well known in the art and are particularly useful for delivery of agents at a particular site, such as can be used with the agents of the present invention. In this embodiment, the dosage unit contains a corresponding multiple of the daily dose.

The effect of a single dose on ALAS1 levels can be long lasting, such that subsequent doses are administered at not more than 3, 4, or 5 day intervals, or at not more than 1, 2, 3, or 4 week intervals.

The skilled artisan will appreciate that certain factors may influence the dosage and timing required to effectively treat a subject, including but not limited to the severity of the disease or disorder, previous treatments, the general health and/or age of the subject, and other diseases present. Moreover, treatment of a subject with a therapeutically effective amount of a composition can include a single treatment or a series of treatments. Estimates of effective dosages and in vivo half-lives for the individual iRNAs encompassed by the invention can be made using conventional methodologies or on the basis of in vivo testing using an appropriate animal model, as described elsewhere herein.

Advances in mouse genetics have generated a number of mouse models for the study of various human diseases, such as pathological processes related to ALAS1 expression (e.g., pathological processes involving porphyrins or defects in the porphyrin pathway, such as, for example, porphyrias). Such models can be used for in vivo testing of iRNA, as well as for determining a therapeutically effective dose and/or an effective dosing regimen.

A suitable mouse model is, for example, a mouse containing a transgene expressing human ALAS1. Mice that have knock-in mutations (e.g., mutations that are associated with acute hepatic porphyrias in humans) can be used to determine the therapeutically effective dosage and/or duration of administration of ALAS1 siRNA. The present invention also includes pharmaceutical compositions and formulations that include the iRNA compounds featured in the invention. The pharmaceutical compositions of the present invention may be administered in a number of ways depending upon whether local or systemic treatment is desired and upon the area to be treated. Administration may be topical (e.g., by a transdermal patch), pulmonary, e.g., by inhalation or insufflation of powders or aerosols, including by nebulizer; intratracheal, intranasal, epidermal and transdermal, oral or parenteral. Parenteral administration includes intravenous, intraarterial, subcutaneous, intraperitoneal or intramuscular injection or infusion; subdermal, e.g., via an implanted device; or intracranial, e.g., by intraparenchymal, intrathecal or intraventricular, administration.

The iRNA can be delivered in a manner to target a particular tissue, such as a tissue that produces erythrocytes. For example, the iRNA can be delivered to bone marrow, liver (e.g., hepatocytes of liver), lymph glands, spleen, lungs (e.g., pleura of lungs) or spine. In one embodiment, the iRNA is delivered to bone marrow.

Pharmaceutical compositions and formulations for topical administration may include transdermal patches, ointments, lotions, creams, gels, drops, suppositories, sprays, liquids and powders. Conventional pharmaceutical carriers, aqueous, powder or oily bases, thickeners and the like may be necessary or desirable. Coated condoms, gloves and the like may also be useful. Suitable topical formulations include those in which the iRNAs featured in the invention are in admixture with a topical delivery agent such as lipids, liposomes, fatty acids, fatty acid esters, steroids, chelating agents and surfactants. Suitable lipids and liposomes include neutral (e.g., dioleoylphosphatidyl DOPE ethanolamine, dimyristoylphosphatidyl choline DMPC, distearolyphosphatidyl choline) negative (e.g., dimyristoylphosphatidyl glycerol DMPG) and cationic (e.g., dioleoyltetramethylaminopropyl DOTAP and dioleoylphosphatidyl ethanolamine DOTMA). iRNAs featured in the invention may be encapsulated within liposomes or may form complexes thereto, in particular to cationic liposomes. Alternatively, iRNAs may be complexed to lipids, in particular to cationic lipids. Suitable fatty acids and esters include but are not limited to arachidonic acid, oleic acid, eicosanoic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a $C_{1-20}$ alkyl ester (e.g., isopropylmyristate IPM), monoglyceride, diglyceride or pharmaceutically acceptable salt thereof. Topical formulations are described in detail in U.S. Pat. No. 6,747,014, which is incorporated herein by reference.

Liposomal Formulations

There are many organized surfactant structures besides microemulsions that have been studied and used for the formulation of drugs. These include monolayers, micelles, bilayers and vesicles. Vesicles, such as liposomes, have attracted great interest because of their specificity and the duration of action they offer from the standpoint of drug delivery. As used in the present invention, the term "liposome" means a vesicle composed of amphiphilic lipids arranged in a spherical bilayer or bilayers.

Liposomes are unilamellar or multilamellar vesicles which have a membrane formed from a lipophilic material and an aqueous interior. The aqueous portion contains the composition to be delivered. Cationic liposomes possess the advantage of being able to fuse to the cell wall. Non-cationic liposomes, although not able to fuse as efficiently with the cell wall, are taken up by macrophages in vivo.

In order to traverse intact mammalian skin, lipid vesicles must pass through a series of fine pores, each with a diameter less than 50 nm, under the influence of a suitable transdermal gradient. Therefore, it is desirable to use a liposome which is highly deformable and able to pass through such fine pores.

Further advantages of liposomes include; liposomes obtained from natural phospholipids are biocompatible and biodegradable; liposomes can incorporate a wide range of water and lipid soluble drugs; liposomes can protect encapsulated drugs in their internal compartments from metabolism and degradation (Rosoff, in Pharmaceutical Dosage Forms, Lieberman, Rieger and Banker (Eds.), 1988, Marcel Dekker, Inc., New York, N.Y., volume 1, p. 245). Important considerations in the preparation of liposome formulations are the lipid surface charge, vesicle size and the aqueous volume of the liposomes.

Liposomes are useful for the transfer and delivery of active ingredients to the site of action. Because the liposomal membrane is structurally similar to biological membranes, when liposomes are applied to a tissue, the liposomes start to merge with the cellular membranes and as the merging of the liposome and cell progresses, the liposomal contents are emptied into the cell where the active agent may act.

Liposomal formulations have been the focus of extensive investigation as the mode of delivery for many drugs. There is growing evidence that for topical administration, liposomes present several advantages over other formulations. Such advantages include reduced side-effects related to high systemic absorption of the administered drug, increased accumulation of the administered drug at the desired target, and the ability to administer a wide variety of drugs, both hydrophilic and hydrophobic, into the skin.

Several reports have detailed the ability of liposomes to deliver agents including high-molecular weight DNA into the skin. Compounds including analgesics, antibodies, hormones and high-molecular weight DNAs have been administered to the skin. The majority of applications resulted in the targeting of the upper epidermis Liposomes fall into two broad classes. Cationic liposomes are positively charged liposomes which interact with the negatively charged DNA molecules to form a stable complex. The positively charged DNA/liposome complex binds to the negatively charged cell surface and is internalized in an endosome. Due to the acidic pH within the endosome, the liposomes are ruptured, releasing their contents into the cell cytoplasm (Wang et al., Biochem. Biophys. Res. Commun., 1987, 147, 980-985).

Liposomes which are pH-sensitive or negatively-charged, entrap DNA rather than complex with it. Since both the DNA and the lipid are similarly charged, repulsion rather than complex formation occurs. Nevertheless, some DNA is entrapped within the aqueous interior of these liposomes. pH-sensitive liposomes have been used to deliver DNA encoding the thymidine kinase gene to cell monolayers in culture. Expression of the exogenous gene was detected in the target cells (Zhou et al., Journal of Controlled Release, 1992, 19, 269-274).

One major type of liposomal composition includes phospholipids other than naturally-derived phosphatidylcholine. Neutral liposome compositions, for example, can be formed from dimyristoyl phosphatidylcholine (DMPC) or dipalmitoyl phosphatidylcholine (DPPC). Anionic liposome compositions generally are formed from dimyristoyl phosphatidylglycerol, while anionic fusogenic liposomes are formed primarily from dioleoyl phosphatidylethanolamine (DOPE). Another type of liposomal composition is formed from phosphatidylcholine (PC) such as, for example, soybean PC, and egg PC. Another type is formed from mixtures of phospholipid and/or phosphatidylcholine and/or cholesterol.

Several studies have assessed the topical delivery of liposomal drug formulations to the skin. Application of liposomes containing interferon to guinea pig skin resulted in a reduction of skin herpes sores while delivery of interferon via other means (e.g., as a solution or as an emulsion) were ineffective (Weiner et al., Journal of Drug Targeting, 1992, 2, 405-410). Further, an additional study tested the efficacy of interferon administered as part of a liposomal formulation to the administration of interferon using an aqueous system, and concluded that the liposomal formulation was superior to aqueous administration (du Plessis et al., Antiviral Research, 1992, 18, 259-265).

Non-ionic liposomal systems have also been examined to determine their utility in the delivery of drugs to the skin, in particular systems comprising non-ionic surfactant and cholesterol. Non-ionic liposomal formulations comprising Novasome™ I (glyceryl dilaurate/cholesterol/polyoxyethylene-10-stearyl ether) and Novasome™ II (glyceryl distearate/cholesterol/polyoxyethylene-10-stearyl ether) were used to deliver cyclosporin-A into the dermis of mouse skin Results indicated that such non-ionic liposomal systems were effective in facilitating the deposition of cyclosporin-A into different layers of the skin (Hu et al. S.T.P. Pharma. Sci., 1994, 4, 6, 466).

Liposomes also include "sterically stabilized" liposomes, a term which, as used herein, refers to liposomes comprising one or more specialized lipids that, when incorporated into liposomes, result in enhanced circulation lifetimes relative to liposomes lacking such specialized lipids. Examples of sterically stabilized liposomes are those in which part of the vesicle-forming lipid portion of the liposome (A) comprises one or more glycolipids, such as monosialoganglioside $G_{M1}$, or (B) is derivatized with one or more hydrophilic polymers, such as a polyethylene glycol (PEG) moiety. While not wishing to be bound by any particular theory, it is thought in the art that, at least for sterically stabilized liposomes containing gangliosides, sphingomyelin, or PEG-derivatized lipids, the enhanced circulation half-life of these sterically stabilized liposomes derives from a reduced uptake into cells of the reticuloendothelial system (RES) (Allen et al., FEBS Letters, 1987, 223, 42; Wu et al., Cancer Research, 1993, 53, 3765).

Various liposomes comprising one or more glycolipids are known in the art. Papahadjopoulos et al. (Ann. N.Y. Acad. Sci., 1987, 507, 64) reported the ability of monosialoganglioside $G_{M1}$, galactocerebroside sulfate and phosphatidylinositol to improve blood half-lives of liposomes. These findings were expounded upon by Gabizon et al. (Proc. Natl. Acad. Sci. U.S.A., 1988, 85, 6949). U.S. Pat. No. 4,837,028 and WO 88/04924, both to Allen et al., disclose liposomes comprising (1) sphingomyelin and (2) the ganglioside $G_{M1}$ or a galactocerebroside sulfate ester. U.S. Pat. No. 5,543,152 (Webb et al.) discloses liposomes comprising sphingomyelin. Liposomes comprising 1,2-sn-dimyristoylphosphatidylcholine are disclosed in WO 97/13499 (Lim et al).

Many liposomes comprising lipids derivatized with one or more hydrophilic polymers, and methods of preparation thereof, are known in the art. Sunamoto et al. (Bull. Chem. Soc. Jpn., 1980, 53, 2778) described liposomes comprising a nonionic detergent, $2C_{1215G}$, that contains a PEG moiety. Illum et al. (FEBS Lett., 1984, 167, 79) noted that hydrophilic coating of polystyrene particles with polymeric glycols results in significantly enhanced blood half-lives. Synthetic phospholipids modified by the attachment of carboxylic groups of polyalkylene glycols (e.g., PEG) are described by Sears (U.S. Pat. Nos. 4,426,330 and 4,534,899). Klibanov et al. (FEBS Lett., 1990, 268, 235) described experiments demonstrating that liposomes comprising phosphatidylethanolamine (PE) derivatized with PEG or PEG stearate have significant increases in blood circulation half-lives. Blume et al. (Biochimica et Biophysica Acta, 1990, 1029, 91) extended such observations to other PEG-derivatized phospholipids, e.g., DSPE-PEG, formed from the combination of distearoylphosphatidylethanolamine (DSPE) and PEG. Liposomes having covalently bound PEG moieties on their external surface are described in European Patent No. EP 0 445 131 B1 and WO 90/04384 to Fisher. Liposome compositions containing 1-20 mole percent of PE derivatized with PEG, and methods of use thereof, are described by Woodle et al. (U.S. Pat. Nos. 5,013,556 and 5,356,633) and Martin et al. (U.S. Pat. No. 5,213,804 and European Patent No. EP 0 496 813 B1). Liposomes comprising a number of other lipid-polymer conjugates are disclosed in WO 91/05545 and U.S. Pat. No. 5,225,212 (both to Martin et al.) and in WO 94/20073 (Zalipsky et al.) Liposomes comprising PEG-modified ceramide lipids are described in WO 96/10391 (Choi et al). U.S. Pat. No. 5,540,935 (Miyazaki et al.) and U.S. Pat. No. 5,556,948 (Tagawa et al.) describe PEG-containing liposomes that can be further derivatized with functional moieties on their surfaces.

A number of liposomes comprising nucleic acids are known in the art. WO 96/40062 to Thierry et al. discloses methods for encapsulating high molecular weight nucleic acids in liposomes. U.S. Pat. No. 5,264,221 to Tagawa et al. discloses protein-bonded liposomes and asserts that the contents of such liposomes may include a dsRNA. U.S. Pat. No. 5,665,710 to Rahman et al. describes certain methods of encapsulating oligodeoxynucleotides in liposomes. WO 97/04787 to Love et al. discloses liposomes comprising dsRNAs targeted to the raf gene.

Transfersomes are yet another type of liposomes, and are highly deformable lipid aggregates which are attractive candidates for drug delivery vehicles. Transfersomes may be described as lipid droplets which are so highly deformable that they are easily able to penetrate through pores which are smaller than the droplet. Transfersomes are adaptable to the environment in which they are used, e.g., they are self-optimizing (adaptive to the shape of pores in the skin), self-repairing, frequently reach their targets without fragmenting, and often self-loading. To make transfersomes it is possible to add surface edge-activators, usually surfactants, to a standard liposomal composition. Transfersomes have been used to deliver serum albumin to the skin. The transfersome-mediated delivery of serum albumin has been shown to be as effective as subcutaneous injection of a solution containing serum albumin.

Surfactants find wide application in formulations such as emulsions (including microemulsions) and liposomes. The most common way of classifying and ranking the properties of the many different types of surfactants, both natural and synthetic, is by the use of the hydrophile/lipophile balance (HLB). The nature of the hydrophilic group (also known as the "head") provides the most useful means for categorizing the different surfactants used in formulations (Rieger, in Pharmaceutical Dosage Forms, Marcel Dekker, Inc., New York, N.Y., 1988, p. 285).

If the surfactant molecule is not ionized, it is classified as a nonionic surfactant. Nonionic surfactants find wide application in pharmaceutical and cosmetic products and are usable over a wide range of pH values. In general their HLB values range from 2 to about 18 depending on their structure. Nonionic surfactants include nonionic esters such as ethylene glycol esters, propylene glycol esters, glyceryl esters, polyglyceryl esters, sorbitan esters, sucrose esters, and ethoxylated esters. Nonionic alkanolamides and ethers such as fatty alcohol ethoxylates, propoxylated alcohols, and ethoxylated/propoxylated block polymers are also included in this class. The polyoxyethylene surfactants are the most popular members of the nonionic surfactant class.

If the surfactant molecule carries a negative charge when it is dissolved or dispersed in water, the surfactant is classified as anionic. Anionic surfactants include carboxylates such as soaps, acyl lactylates, acyl amides of amino acids, esters of sulfuric acid such as alkyl sulfates and ethoxylated alkyl sulfates, sulfonates such as alkyl benzene sulfonates, acyl isethionates, acyl taurates and sulfosuccinates, and phosphates. The most important members of the anionic surfactant class are the alkyl sulfates and the soaps.

If the surfactant molecule carries a positive charge when it is dissolved or dispersed in water, the surfactant is classified as cationic. Cationic surfactants include quaternary ammonium salts and ethoxylated amines. The quaternary ammonium salts are the most used members of this class.

If the surfactant molecule has the ability to carry either a positive or negative charge, the surfactant is classified as amphoteric Amphoteric surfactants include acrylic acid derivatives, substituted alkylamides, N-alkylbetaines and phosphatides.

The use of surfactants in drug products, formulations and in emulsions has been reviewed (Rieger, in Pharmaceutical Dosage Forms, Marcel Dekker, Inc., New York, N.Y., 1988, p. 285).

Nucleic Acid Lipid Particles

In one embodiment, an ALAS1 dsRNA featured in the invention is fully encapsulated in the lipid formulation, e.g., to form a SPLP, pSPLP, SNALP, or other nucleic acid-lipid particle. As used herein, the term "SNALP" refers to a stable nucleic acid-lipid particle, including SPLP. As used herein, the term "SPLP" refers to a nucleic acid-lipid particle comprising plasmid DNA encapsulated within a lipid vesicle. SNALPs and SPLPs typically contain a cationic lipid, a non-cationic lipid, and a lipid that prevents aggregation of the particle (e.g., a PEG-lipid conjugate). SNALPs and SPLPs are extremely useful for systemic applications, as they exhibit extended circulation lifetimes following intravenous (i.v.) injection and accumulate at distal sites (e.g., sites physically separated from the administration site). SPLPs include "pSPLP," which include an encapsulated condensing agent-nucleic acid complex as set forth in PCT Publication No. WO 00/03683. The particles of the present invention typically have a mean diameter of about 50 nm to about 150 nm, more typically about 60 nm to about 130 nm, more typically about 70 nm to about 110 nm, most typically about 70 nm to about 90 nm, and are substantially nontoxic. In addition, the nucleic acids when present in the nucleic acid-lipid particles of the present invention are resistant in aqueous solution to degradation with a nuclease. Nucleic acid-lipid particles and their method of preparation are disclosed in, e.g., U.S. Pat. Nos. 5,976,567; 5,981,501; 6,534,484; 6,586,410; 6,815,432; and PCT Publication No. WO 96/40964.

In one embodiment, the lipid to drug ratio (mass/mass ratio) (e.g., lipid to dsRNA ratio) will be in the range of from about 1:1 to about 50:1, from about 1:1 to about 25:1, from about 3:1 to about 15:1, from about 4:1 to about 10:1, from about 5:1 to about 9:1, or about 6:1 to about 9:1.

The cationic lipid may be, for example, N,N-dioleyl-N, N-dimethylammonium chloride (DODAC), N,N-distearyl-N,N-dimethylammonium bromide (DDAB), N-(I-(2,3-dioleyloxy)propyl)-N,N,N-trimethylammonium chloride (DOTAP), N-(I-(2,3-dioleyloxy)propyl)-N,N,N-trimethylammonium chloride (DOTMA), N,N-dimethyl-2,3-dioleyloxy)propylamine (DODMA), 1,2-DiLinoleyloxy-N,N-dimethylaminopropane (DLinDMA), 1,2-Dilinolenyloxy-N,N-dimethylaminopropane (DLenDMA), 1,2-Dilinoleylcarbamoyloxy-3-dimethylaminopropane (DLin-C-DAP), 1,2-Dilinoleyoxy-3-(dimethylamino)acetoxypropane (DLin-DAC), 1,2-Dilinoleyoxy-3-morpholinopropane (DLin-MA), 1,2-Dilinoleoyl-3-dimethylaminopropane (DLinDAP), 1,2-Dilinoleylthio-3-dimethylaminopropane (DLin-S-DMA), 1-Linoleoyl-2-linoleyloxy-3-dimethylaminopropane (DLin-2-DMAP), 1,2-Dilinoleyloxy-3-trimethylaminopropane chloride salt (DLin-TMA.Cl), 1,2-Dilinoleoyl-3-trimethylaminopropane chloride salt (DLin-TAP.Cl), 1,2-Dilinoleyloxy-3-(N-methylpiperazino)propane (DLin-MPZ), or 3-(N,N-Dilinoleylamino)-1,2-propanediol (DLinAP), 3-(N,N-Dioleylamino)-1,2-propanedio (DOAP), 1,2-Dilinoleyloxo-3-(2-N,N-dimethylamino)ethoxypropane (DLin-EG-DMA), 1,2-Dilinolenyloxy-N,N-dimethylaminopropane (DLinDMA), 2,2-Dilinoleyl-4-dimethylaminomethyl-[1,3]-dioxolane (DLin-K-DMA) or analogs thereof, (3aR,5s,6aS)-N,N-dimethyl-2,2-di((9Z,12Z)-octadeca-9,12-dienyl)tetrahydro-3aH-cyclopenta[d][1,3]dioxol-5-amine (ALN100), (6Z,9Z,28Z,31Z)-heptatriaconta-6,9,28,31-tetraen-19-yl 4-(dimethylamino)butanoate (MC3), 1,1'-(2-(4-(2-((2-(bis (2-hydroxydodecyl)amino)ethyl)(2-hydroxydodecyl)amino) ethyl)piperazin-1-yl)ethylazanediyl)didodecan-2-ol (Tech G1), or a mixture thereof. The cationic lipid may comprise from about 20 mol % to about 50 mol % or about 40 mol % of the total lipid present in the particle.

In another embodiment, the compound 2,2-Dilinoleyl-4-dimethylaminoethyl-[1,3]-dioxolane can be used to prepare lipid-siRNA nanoparticles. Synthesis of 2,2-Dilinoleyl-4-dimethylaminoethyl-[1,3]-dioxolane is described in U.S. provisional patent application No. 61/107,998 filed on Oct. 23, 2008, which is herein incorporated by reference.

In one embodiment, the lipid-siRNA particle includes 40% 2,2-Dilinoleyl-4-dimethylaminoethyl-[1,3]-dioxolane: 10% DSPC: 40% Cholesterol: 10% PEG-C-DOMG (mole percent) with a particle size of 63.0±20 nm and a 0.027 siRNA/Lipid Ratio.

The non-cationic lipid may be an anionic lipid or a neutral lipid including, but not limited to, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoylphosphatidylethanolamine (POPE), dioleoyl-phosphatidylethanolamine 4-(N-maleimidomethyl)-cyclohexane-1-carboxylate (DOPE-mal), dipalmitoyl phosphatidyl ethanolamine (DPPE), dimyristoylphosphoethanolamine (DMPE), distearoyl-phosphatidyl-ethanolamine (DSPE),16-O-monomethyl PE, 16-O-dimethyl PE, 18-1-trans PE, 1-stearoyl-2-oleoyl-phosphatidyethanolamine (SOPE), cholesterol, or a mixture thereof. The non-cationic lipid may be from about 5 mol % to about 90 mol %, about 10 mol %, or about 58 mol % if cholesterol is included, of the total lipid present in the particle.

The conjugated lipid that inhibits aggregation of particles may be, for example, a polyethyleneglycol (PEG)-lipid including, without limitation, a PEG-diacylglycerol (DAG), a PEG-dialkyloxypropyl (DAA), a PEG-phospholipid, a PEG-ceramide (Cer), or a mixture thereof. The PEG-DAA conjugate may be, for example, a PEG-dilauryloxypropyl ($C_{12}$), a PEG-dimyristyloxypropyl ($C_{14}$), a PEG-dipalmityloxypropyl ($C_{16}$), or a PEG-distearyloxypropyl ($C_{18}$). The conjugated lipid that prevents aggregation of particles may be from 0 mol % to about 20 mol % or about 2 mol % of the total lipid present in the particle.

In some embodiments, the nucleic acid-lipid particle further includes cholesterol at, e.g., about 10 mol % to about 60 mol % or about 48 mol % of the total lipid present in the particle.

In some embodiments, the iRNA is formulated in a lipid nanoparticle (LNP).

LNP01

In one embodiment, the lipidoid ND98.4HCl (MW 1487) (see U.S. patent application Ser. No. 12/056,230, filed Mar. 26, 2008, which is herein incorporated by reference), Cholesterol (Sigma-Aldrich), and PEG-Ceramide C16 (Avanti Polar Lipids) can be used to prepare lipid-dsRNA nanoparticles (e.g., LNP01 particles). Stock solutions of each in ethanol can be prepared as follows: ND98, 133 mg/ml; Cholesterol, 25 mg/ml, PEG-Ceramide C16, 100 mg/ml. The ND98, Cholesterol, and PEG-Ceramide C16 stock solutions can then be combined in a, e.g., 42:48:10 molar ratio. The combined lipid solution can be mixed with aqueous dsRNA (e.g., in sodium acetate pH 5) such that the final ethanol concentration is about 35-45% and the final sodium acetate concentration is about 100-300 mM. Lipid-dsRNA nanoparticles typically form spontaneously upon mixing. Depending on the desired particle size distribution, the resultant nanoparticle mixture can be extruded through a polycarbonate membrane (e.g., 100 nm cut-off) using, for example, a thermobarrel extruder, such as Lipex Extruder (Northern Lipids, Inc). In some cases, the extrusion step can be omitted. Ethanol removal and simultaneous buffer exchange can be accomplished by, for example, dialysis or tangential flow filtration. Buffer can be exchanged with, for example, phosphate buffered saline (PBS) at about pH 7, e.g., about pH 6.9, about pH 7.0, about pH 7.1, about pH 7.2, about pH 7.3, or about pH 7.4.

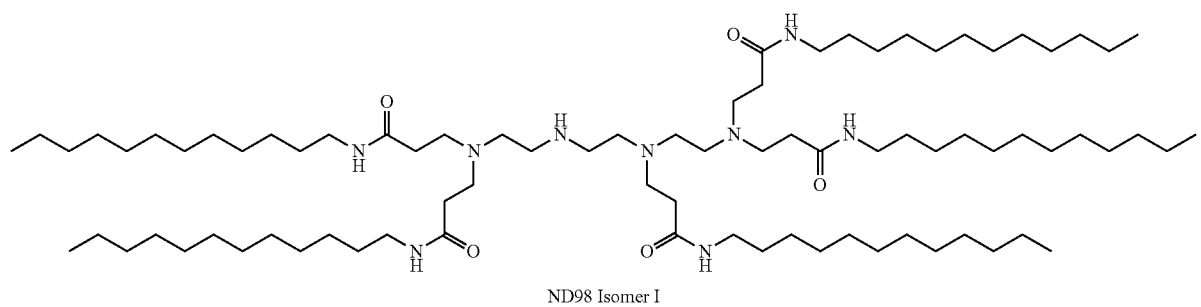

Formula 1

ND98 Isomer I

LNP01 formulations are described, e.g., in International Application Publication No. WO 2008/042973, which is hereby incorporated by reference.

Additional exemplary lipid-dsRNA formulations are provided in the following table.

TABLE 10

Examplary lipid formulations

| | Cationic Lipid | cationic lipid/non-cationic lipid/cholesterol/PEG-lipid conjugate Lipid:siRNA ratio |
|---|---|---|
| SNALP | 1,2-Dilinolenyloxy-N,N-dimethylaminopropane (DLinDMA) | DLinDMA/DPPC/Cholesterol/PEG-cDMA (57.1/7.1/34.4/1.4) lipid:siRNA ~7:1 |
| S-XTC | 2,2-Dilinoleyl-4-dimethylaminoethyl-[1,3]-dioxolane (XTC) | XTC/DPPC/Cholesterol/PEG-cDMA 57.1/7.1/34.4/1.4 lipid:siRNA ~7:1 |
| LNP05 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA ~6:1 |
| LNP06 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA ~11:1 |
| LNP07 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA ~6:1 |
| LNP08 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA ~11:1 |
| LNP09 | 2,2-Dilinoleyl-4-dimethylaminoethyl-[1,3]-dioxolane (XTC) | XTC/DSPC/Cholesterol/PEG-DMG 50/10/38.5/1.5 Lipid:siRNA 10:1 |
| LNP10 | (3aR,5s,6aS)-N,N-dimethyl-2,2-di((9Z,12Z)-octadeca-9,12-dienyl)tetrahydro-3aH-cyclopenta[d][1,3]dioxol-5-amine (ALN100) | ALN100/DSPC/Cholesterol/PEG-DMG 50/10/38.5/1.5 Lipid:siRNA 10:1 |
| LNP11 | (6Z,9Z,28Z,31Z)-heptatriaconta-6,9,28,31-tetraen-19-yl 4-(dimethylamino)butanoate (MC3) | MC-3/DSPC/Cholesterol/PEG-DMG 50/10/38.5/1.5 Lipid:siRNA 10:1 |
| LNP12 | 1,1'-(2-(4-(2-((2-(bis(2-hydroxydodecyl)amino)ethyl)(2-hydroxydodecyl)amino)ethyl)piperazin-1-yl)ethylazanediyl)didodecan-2-ol (C12-200) | C12-200/DSPC/Cholesterol/PEG-DMG 50/10/38.5/1.5 Lipid:siRNA 10:1 |
| LNP13 | XTC | XTC/DSPC/Chol/PEG-DMG 50/10/38.5/1.5 Lipid:siRNA: 33:1 |
| LNP14 | MC3 | MC3/DSPC/Chol/PEG-DMG 40/15/40/5 Lipid:siRNA: 11:1 |
| LNP15 | MC3 | MC3/DSPC/Chol/PEG-DSG/GalNAc-PEG-DSG 50/10/35/4.5/0.5 Lipid:siRNA: 11:1 |

TABLE 10-continued

Examplary lipid formulations

| | Cationic Lipid | cationic lipid/non-cationic lipid/cholesterol/PEG-lipid conjugate Lipid:siRNA ratio |
|---|---|---|
| LNP16 | MC3 | MC3/DSPC/Chol/PEG-DMG 50/10/38.5/1.5 Lipid:siRNA: 7:1 |
| LNP17 | MC3 | MC3/DSPC/Chol/PEG-DSG 50/10/38.5/1.5 Lipid:siRNA: 10:1 |
| LNP18 | MC3 | MC3/DSPC/Chol/PEG-DMG 50/10/38.5/1.5 Lipid:siRNA: 12:1 |
| LNP19 | MC3 | MC3/DSPC/Chol/PEG-DMG 50/10/35/5 Lipid:siRNA: 8:1 |
| LNP20 | MC3 | MC3/DSPC/Chol/PEG-DPG 50/10/38.5/1.5 Lipid:siRNA: 10:1 |
| LNP21 | C12-200 | C12-200/DSPC/Chol/PEG-DSG 50/10/38.5/1.5 Lipid:siRNA: 7:1 |
| LNP22 | XTC | XTC/DSPC/Chol/PEG-DSG 50/10/38.5/1.5 Lipid:siRNA: 10:1 |

DSPC: distearoylphosphatidylcholine
DPPC: dipalmitoylphosphatidylcholine
PEG-DMG: PEG-didimyristoyl glycerol (C14-PEG, or PEG-C14) (PEG with avg mol wt of 2000)
PEG-DSG: PEG-distyryl glycerol (C18-PEG, or PEG-C18) (PEG with avg mol wt of 2000)
PEG-cDMA: PEG-carbamoyl-1,2-dimyristyloxypropylamine (PEG with avg mol wt of 2000)

SNALP (1,2-Dilinolenyloxy-N,N-dimethylaminopropane (DLinDMA)) comprising formulations are described in International Publication No. WO2009/127060, filed Apr. 15, 2009, which is hereby incorporated by reference.

XTC comprising formulations are described, e.g., in U.S. Provisional Ser. No. 61/148,366, filed Jan. 29, 2009; U.S. Provisional Ser. No. 61/156,851, filed Mar. 2, 2009; U.S. Provisional Serial No. filed Jun. 10, 2009; U.S. Provisional Ser. No. 61/228,373, filed Jul. 24, 2009; U.S. Provisional Ser. No. 61/239,686, filed Sep. 3, 2009, and International Application No. PCT/US2010/022614, filed Jan. 29, 2010, which are hereby incorporated by reference.

MC3 comprising formulations are described, e.g., in U.S. Provisional Ser. No. 61/244,834, filed Sep. 22, 2009, U.S. Provisional Ser. No. 61/185,800, filed Jun. 10, 2009, and International Application No. PCT/US10/28224, filed Jun. 10, 2010, which are hereby incorporated by reference.

ALNY-100 comprising formulations are described, e.g., International patent application number PCT/US09/63933, filed on Nov. 10, 2009, which is hereby incorporated by reference.

C12-200 comprising formulations are described in U.S. Provisional Ser. No. 61/175,770, filed May 5, 2009 and International Application No. PCT/US10/33777, filed May 5, 2010, which are hereby incorporated by reference.

Synthesis of Cationic Lipids

Any of the compounds, e.g., cationic lipids and the like, used in the nucleic acid-lipid particles featured in the invention may be prepared by known organic synthesis techniques, including the methods described in more detail in the Examples. All substituents are as defined below unless indicated otherwise.

"Alkyl" means a straight chain or branched, noncyclic or cyclic, saturated aliphatic hydrocarbon containing from 1 to 24 carbon atoms. Representative saturated straight chain alkyls include methyl, ethyl, n-propyl, n-butyl, n-pentyl, n-hexyl, and the like; while saturated branched alkyls include isopropyl, sec-butyl, isobutyl, tert-butyl, isopentyl, and the like. Representative saturated cyclic alkyls include cyclopropyl, cyclobutyl, cyclopentyl, cyclohexyl, and the like; while unsaturated cyclic alkyls include cyclopentenyl and cyclohexenyl, and the like.

"Alkenyl" means an alkyl, as defined above, containing at least one double bond between adjacent carbon atoms. Alkenyls include both cis and trans isomers. Representative straight chain and branched alkenyls include ethylenyl, propylenyl, 1-butenyl, 2-butenyl, isobutylenyl, 1-pentenyl, 2-pentenyl, 3-methyl-1-butenyl, 2-methyl-2-butenyl, 2,3-dimethyl-2-butenyl, and the like.

"Alkynyl" means any alkyl or alkenyl, as defined above, which additionally contains at least one triple bond between adjacent carbons. Representative straight chain and branched alkynyls include acetylenyl, propynyl, 1-butynyl, 2-butynyl, 1-pentynyl, 2-pentynyl, 3-methyl-1 butynyl, and the like.

"Acyl" means any alkyl, alkenyl, or alkynyl wherein the carbon at the point of attachment is substituted with an oxo group, as defined below. For example, —C(=O)alkyl, —C(=O)alkenyl, and —C(=O)alkynyl are acyl groups.

"Heterocycle" means a 5- to 7-membered monocyclic, or 7- to 10-membered bicyclic, heterocyclic ring which is either saturated, unsaturated, or aromatic, and which contains from 1 or 2 heteroatoms independently selected from nitrogen, oxygen and sulfur, and wherein the nitrogen and sulfur heteroatoms may be optionally oxidized, and the nitrogen heteroatom may be optionally quaternized, including bicyclic rings in which any of the above heterocycles are fused to a benzene ring. The heterocycle may be attached via any heteroatom or carbon atom. Heterocycles include heteroaryls as defined below. Heterocycles include morpholinyl, pyrrolidinonyl, pyrrolidinyl, piperidinyl, piperizynyl, hydantoinyl, valerolactamyl, oxiranyl, oxetanyl, tetrahydrofuranyl, tetrahydropyranyl, tetrahydropyridinyl, tetrahydroprimidinyl, tetrahydrothiophenyl, tetrahydrothiopyranyl, tetrahydropyrimidinyl, tetrahydrothiophenyl, tetrahydrothiopyranyl, and the like.

The terms "optionally substituted alkyl", "optionally substituted alkenyl", "optionally substituted alkynyl", "optionally substituted acyl", and "optionally substituted heterocycle" means that, when substituted, at least one hydrogen atom is replaced with a substituent. In the case of an oxo substituent (=O) two hydrogen atoms are replaced. In this regard, substituents include oxo, halogen, heterocycle, —CN, —OR$^x$, —NR$^x$R$^y$, —NR$^x$C(=O)R$^y$, —NR$^x$SO$_2$R$^y$, —C(=O)R$^x$, —C(=O)OR$^x$, —C(=O)NR$^x$R$^y$, —SO$_n$R$^x$ and —SO$_n$NR$^x$R$^y$, wherein n is 0, 1 or 2, R$^x$ and R$^y$ are the same or different and independently hydrogen, alkyl or heterocycle, and each of said alkyl and heterocycle substituents may be further substituted with one or more of oxo, halogen, —OH, —CN, alkyl, —OR$^x$, heterocycle, —NR$^x$R$^y$, —NR$^x$C(=O)R$^y$, —NR$^x$SO$_2$R$^y$, —C(=O)R$^x$, —C(=O)OR$^x$, —C(=O)NR$^x$R$^y$, —SO$_n$R$^x$ and —SO$_n$-NR$^x$R$^y$.

"Halogen" means fluoro, chloro, bromo and iodo.

In some embodiments, the methods featured in the invention may require the use of protecting groups. Protecting group methodology is well known to those skilled in the art (see, for example, PROTECTIVE GROUPS IN ORGANIC SYNTHESIS, Green, T. W. et al., Wiley-Interscience, New York City, 1999). Briefly, protecting groups within the context of this invention are any group that reduces or eliminates unwanted reactivity of a functional group. A protecting group can be added to a functional group to mask its reactivity during certain reactions and then removed to reveal the original functional group. In some embodiments an "alcohol protecting group" is used. An "alcohol protecting group" is any group which decreases or eliminates unwanted reactivity of an alcohol functional group. Protecting groups can be added and removed using techniques well known in the art.

Synthesis of Formula A

In one embodiments, nucleic acid-lipid particles featured in the invention are formulated using a cationic lipid of formula A:

where R1 and R2 are independently alkyl, alkenyl or alkynyl, each can be optionally substituted, and R3 and R4 are independently lower alkyl or R3 and R4 can be taken together to form an optionally substituted heterocyclic ring. In some embodiments, the cationic lipid is XTC (2,2-Dilinoleyl-4-dimethylaminoethyl-[1,3]-dioxolane). In general, the lipid of formula A above may be made by the following Reaction Schemes 1 or 2, wherein all substituents are as defined above unless indicated otherwise.

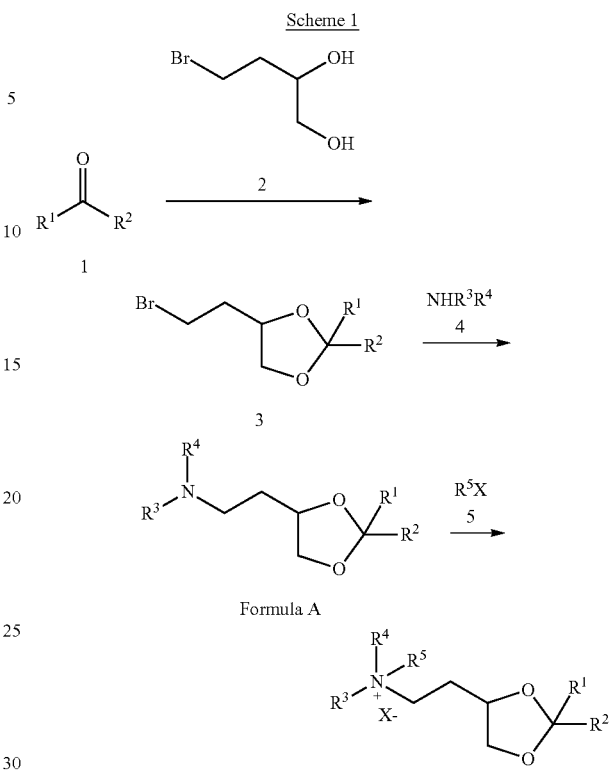

Lipid A, where R$_1$ and R$_2$ are independently alkyl, alkenyl or alkynyl, each can be optionally substituted, and R$_3$ and R$_4$ are independently lower alkyl or R$_3$ and R$_4$ can be taken together to form an optionally substituted heterocyclic ring, can be prepared according to Scheme 1. Ketone 1 and bromide 2 can be purchased or prepared according to methods known to those of ordinary skill in the art. Reaction of 1 and 2 yields ketal 3. Treatment of ketal 3 with amine 4 yields lipids of formula A. The lipids of formula A can be converted to the corresponding ammonium salt with an organic salt of formula 5, where X is anion counter ion selected from halogen, hydroxide, phosphate, sulfate, or the like.

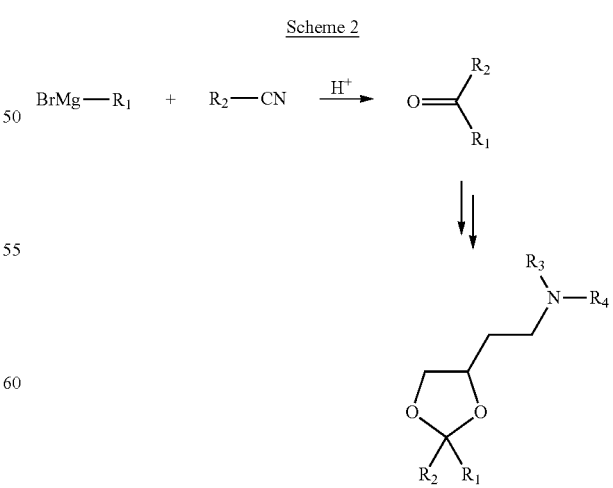

Alternatively, the ketone 1 starting material can be prepared according to Scheme 2. Grignard reagent 6 and cyanide 7 can be purchased or prepared according to methods known to those of ordinary skill in the art. Reaction of 6 and 7 yields ketone 1. Conversion of ketone 1 to the corresponding lipids of formula A is as described in Scheme 1.

Synthesis of MC3

Preparation of DLin-M-C3-DMA (i.e., (6Z,9Z,28Z,31Z)-heptatriaconta-6,9,28,31-tetraen-19-yl 4-(dimethylamino)butanoate) was as follows. A solution of (6Z,9Z,28Z,31Z)-heptatriaconta-6,9,28,31-tetraen-19-ol (0.53 g), 4-N,N-dimethylaminobutyric acid hydrochloride (0.51 g), 4-N,N-dimethylaminopyridine (0.61 g) and 1-ethyl-3-(3-dimethylaminopropyl)carbodiimide hydrochloride (0.53 g) in dichloromethane (5 mL) was stirred at room temperature overnight. The solution was washed with dilute hydrochloric acid followed by dilute aqueous sodium bicarbonate. The organic fractions were dried over anhydrous magnesium sulphate, filtered and the solvent removed on a rotovap. The residue was passed down a silica gel column (20 g) using a 1-5% methanol/dichloromethane elution gradient. Fractions containing the purified product were combined and the solvent removed, yielding a colorless oil (0.54 g).

Synthesis of ALNY-100

Synthesis of ketal 519 [ALNY-100] was performed using the following scheme 3:

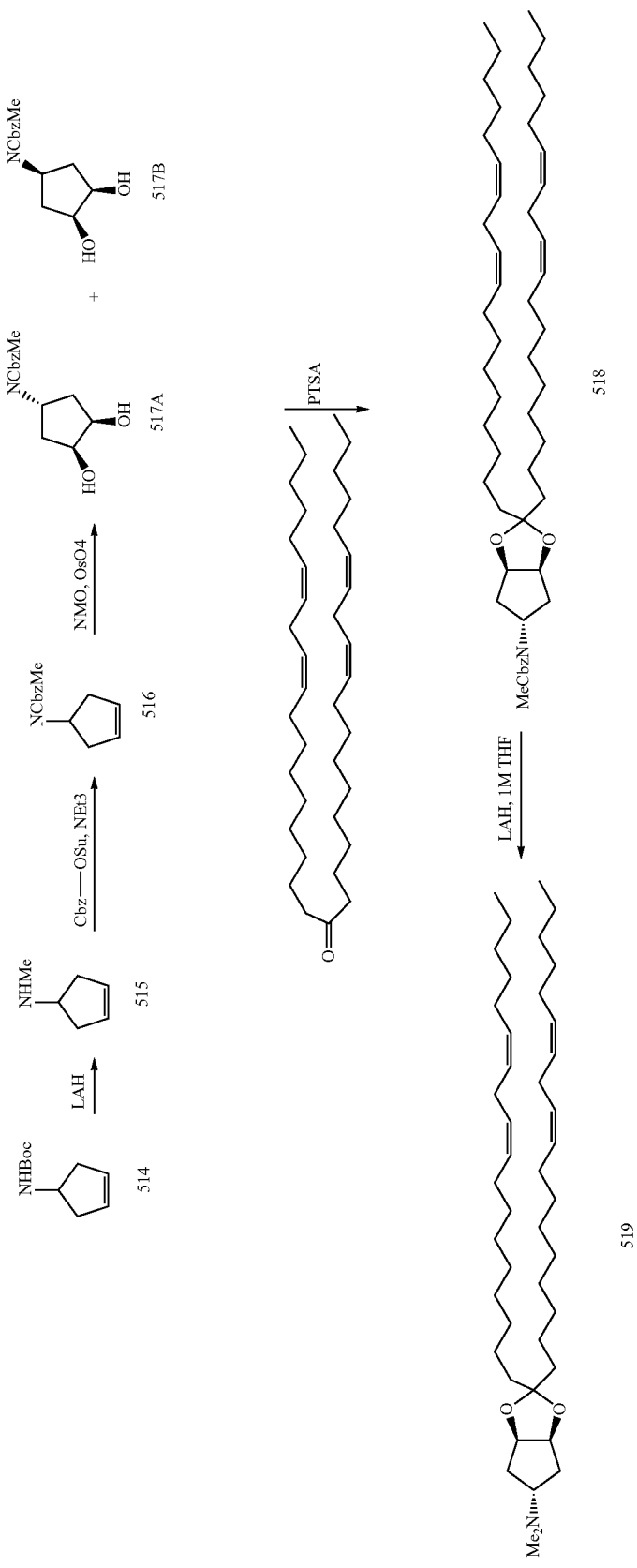

Synthesis of 515:

To a stirred suspension of LiAlH4 (3.74 g, 0.09852 mol) in 200 ml anhydrous THF in a two neck RBF (1 L), was added a solution of 514 (10 g, 0.04926 mol) in 70 mL of THF slowly at 0° C. under nitrogen atmosphere. After complete addition, reaction mixture was warmed to room temperature and then heated to reflux for 4 h. Progress of the reaction was monitored by TLC. After completion of reaction (by TLC) the mixture was cooled to 0° C. and quenched with careful addition of saturated Na2SO4 solution. Reaction mixture was stirred for 4 h at room temperature and filtered off. Residue was washed well with THF. The filtrate and washings were mixed and diluted with 400 mL dioxane and 26 mL conc. HCl and stirred for 20 minutes at room temperature. The volatilities were stripped off under vacuum to furnish the hydrochloride salt of 515 as a white solid. Yield: 7.12 g 1H-NMR (DMSO, 400 MHz): δ=9.34 (broad, 2H), 5.68 (s, 2H), 3.74 (m, 1H), 2.66-2.60 (m, 2H), 2.50-2.45 (m, 5H).

Synthesis of 516:

To a stirred solution of compound 515 in 100 mL dry DCM in a 250 mL two neck RBF, was added NEt3 (37.2 mL, 0.2669 mol) and cooled to 0° C. under nitrogen atmosphere. After a slow addition of N-(benzyloxy-carbonyloxy)-succinimide (20 g, 0.08007 mol) in 50 mL dry DCM, reaction mixture was allowed to warm to room temperature. After completion of the reaction (2-3 h by TLC) mixture was washed successively with 1N HCl solution (1×100 mL) and saturated NaHCO3 solution (1×50 mL) The organic layer was then dried over anhyd. Na2SO4 and the solvent was evaporated to give crude material which was purified by silica gel column chromatography to get 516 as sticky mass. Yield: 11 g (89%). 1H-NMR (CDCl3, 400 MHz): δ=7.36-7.27 (m, 5H), 5.69 (s, 2H), 5.12 (s, 2H), 4.96 (br., 1H) 2.74 (s, 3H), 2.60 (m, 2H), 2.30-2.25 (m, 2H). LC-MS [M+H]−232.3 (96.94%).

Synthesis of 517A and 517B:

The cyclopentene 516 (5 g, 0.02164 mol) was dissolved in a solution of 220 mL acetone and water (10:1) in a single neck 500 mL RBF and to it was added N-methyl morpholine-N-oxide (7.6 g, 0.06492 mol) followed by 4.2 mL of 7.6% solution of OsO4 (0.275 g, 0.00108 mol) in tert-butanol at room temperature. After completion of the reaction (~3 h), the mixture was quenched with addition of solid Na2SO3 and resulting mixture was stirred for 1.5 h at room temperature. Reaction mixture was diluted with DCM (300 mL) and washed with water (2×100 mL) followed by saturated NaHCO3 (1×50 mL) solution, water (1×30 mL) and finally with brine (1×50 mL) Organic phase was dried over an Na2SO4 and solvent was removed in vacuum. Silica gel column chromatographic purification of the crude material was afforded a mixture of diastereomers, which were separated by prep HPLC. Yield: ~6 g crude 517A—Peak-1 (white solid), 5.13 g (96%). 1H-NMR (DMSO, 400 MHz): δ=7.39-7.31 (m, 5H), 5.04 (s, 2H), 4.78-4.73 (m, 1H), 4.48-4.47 (d, 2H), 3.94-3.93 (m, 2H), 2.71 (s, 3H), 1.72-1.67 (m, 4H). LC-MS-[M+H]−266.3, [M+NH4+]−283.5 present, HPLC-97.86%. Stereochemistry confirmed by X-ray.

Synthesis of 518:

Using a procedure analogous to that described for the synthesis of compound 505, compound 518 (1.2 g, 41%) was obtained as a colorless oil. 1H-NMR (CDCl3, 400 MHz): δ=7.35-7.33 (m, 4H), 7.30-7.27 (m, 1H), 5.37-5.27 (m, 8H), 5.12 (s, 2H), 4.75 (m, 1H), 4.58-4.57 (m, 2H), 2.78-2.74 (m, 7H), 2.06-2.00 (m, 8H), 1.96-1.91 (m, 2H), 1.62 (m, 4H), 1.48 (m, 2H), 1.37-1.25 (br m, 36H), 0.87 (m, 6H). HPLC-98.65%.

General Procedure for the Synthesis of Compound 519:

A solution of compound 518 (1 eq) in hexane (15 mL) was added in a drop-wise fashion to an ice-cold solution of LAH in THF (1 M, 2 eq). After complete addition, the mixture was heated at 40° C. over 0.5 h then cooled again on an ice bath. The mixture was carefully hydrolyzed with saturated aqueous Na2SO4 then filtered through celite and reduced to an oil. Column chromatography provided the pure 519 (1.3 g, 68%) which was obtained as a colorless oil. 13C NMR=130.2, 130.1 (x2), 127.9 (x3), 112.3, 79.3, 64.4, 44.7, 38.3, 35.4, 31.5, 29.9 (x2), 29.7, 29.6 (x2), 29.5 (x3), 29.3 (x2), 27.2 (x3), 25.6, 24.5, 23.3, 226, 14.1; Electrospray MS (+ve): Molecular weight for C44H80NO2 (M+H)+ Calc. 654.6. Found 654.6.

Formulations prepared by either the standard or extrusion-free method can be characterized in similar manners. For example, formulations are typically characterized by visual inspection. They should be whitish translucent solutions free from aggregates or sediment. Particle size and particle size distribution of lipid-nanoparticles can be measured by light scattering using, for example, a Malvern Zetasizer Nano ZS (Malvern, USA). Particles should be about 20-300 nm, such as 40-100 nm in size. The particle size distribution should be unimodal. The total dsRNA concentration in the formulation, as well as the entrapped fraction, is estimated using a dye exclusion assay. A sample of the formulated dsRNA can be incubated with an RNA-binding dye, such as Ribogreen (Molecular Probes) in the presence or absence of a formulation disrupting surfactant, e.g., 0.5% Triton-X100. The total dsRNA in the formulation can be determined by the signal from the sample containing the surfactant, relative to a standard curve. The entrapped fraction is determined by subtracting the "free" dsRNA content (as measured by the signal in the absence of surfactant) from the total dsRNA content. Percent entrapped dsRNA is typically >85%. For SNALP formulation, the particle size is at least 30 nm, at least 40 nm, at least 50 nm, at least 60 nm, at least 70 nm, at least 80 nm, at least 90 nm, at least 100 nm, at least 110 nm, and at least 120 nm. The suitable range is typically about at least 50 nm to about at least 110 nm, about at least 60 nm to about at least 100 nm, or about at least 80 nm to about at least 90 nm.

Compositions and formulations for oral administration include powders or granules, microparticulates, nanoparticulates, suspensions or solutions in water or non-aqueous media, capsules, gel capsules, sachets, tablets or minitablets. Thickeners, flavoring agents, diluents, emulsifiers, dispersing aids or binders may be desirable. In some embodiments, oral formulations are those in which dsRNAs featured in the invention are administered in conjunction with one or more penetration enhancers surfactants and chelators. Suitable surfactants include fatty acids and/or esters or salts thereof, bile acids and/or salts thereof. Suitable bile acids/salts include chenodeoxycholic acid (CDCA) and ursodeoxychenodeoxycholic acid (UDCA), cholic acid, dehydrocholic acid, deoxycholic acid, glucholic acid, glycholic acid, glycodeoxycholic acid, taurocholic acid, taurodeoxycholic acid, sodium tauro-24,25-dihydro-fusidate and sodium glycodihydrofusidate. Suitable fatty acids include arachidonic acid, undecanoic acid, oleic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a monoglyceride, a diglyceride or a pharmaceutically acceptable salt thereof (e.g., sodium). In some embodiments, combinations of penetration enhancers are used, for example, fatty acids/salts in combination with bile acids/salts. One exemplary combination is the sodium salt of lauric acid, capric acid and UDCA. Further penetration enhancers include polyoxyethylene-9-lauryl ether, polyoxyethylene-20-cetyl ether. DsRNAs featured in the invention may be delivered orally, in granular form including sprayed dried particles, or complexed to form micro or nanoparticles. DsRNA complexing agents include poly-amino acids; polyimines; polyacrylates; polyalkylacrylates, polyoxethanes, polyalkylcyanoacrylates; cationized gelatins, albumins, starches, acrylates, polyethyleneglycols (PEG) and starches; polyalkylcyanoacrylates; DEAE-derivatized polyimines, pollulans, celluloses and starches. Suitable complexing agents include chitosan, N-trimethylchitosan, poly-L-lysine, polyhistidine, polyornithine, polyspermines, protamine, polyvinylpyridine, polythiodiethylaminomethylethylene P(TDAE), polyaminostyrene (e.g., p-amino), poly(methylcyanoacrylate), poly(ethylcyanoacrylate), poly(butylcyanoacrylate), poly(isobutylcyanoacrylate), poly(isohexylcynaoacrylate), DEAE-methacrylate, DEAE-hexylacrylate, DEAE-acrylamide, DEAE-albumin and DEAE-dextran, polymethylacrylate, polyhexylacrylate, poly(D,L-lactic acid), poly(DL-lactic-co-glycolic acid (PLGA), alginate, and polyethyleneglycol (PEG). Oral formulations for dsRNAs and their preparation are described in detail in U.S. Pat. No. 6,887,906, US Publn. No. 20030027780, and U.S. Pat. No. 6,747,014, each of which is incorporated herein by reference.

Compositions and formulations for parenteral, intraparenchymal (into the brain), intrathecal, intraventricular or intrahepatic administration may include sterile aqueous solutions which may also contain buffers, diluents and other suitable additives such as, but not limited to, penetration enhancers, carrier compounds and other pharmaceutically acceptable carriers or excipients.

Pharmaceutical compositions of the present invention include, but are not limited to, solutions, emulsions, and liposome-containing formulations. These compositions may be generated from a variety of components that include, but are not limited to, preformed liquids, self-emulsifying solids and self-emulsifying semisolids.

The pharmaceutical formulations featured in the present invention, which may conveniently be presented in unit dosage form, may be prepared according to conventional techniques well known in the pharmaceutical industry. Such techniques include the step of bringing into association the active ingredients with the pharmaceutical carrier(s) or excipient(s). In general, the formulations are prepared by uniformly and intimately bringing into association the active ingredients with liquid carriers or finely divided solid carriers or both, and then, if necessary, shaping the product.

The compositions featured in the present invention may be formulated into any of many possible dosage forms such as, but not limited to, tablets, capsules, gel capsules, liquid syrups, soft gels, suppositories, and enemas. The compositions may also be formulated as suspensions in aqueous, non-aqueous or mixed media. Aqueous suspensions may further contain substances which increase the viscosity of the suspension including, for example, sodium carboxymethylcellulose, sorbitol and/or dextran. The suspension may also contain stabilizers.

Additional Formulations
Emulsions

The compositions of the present invention may be prepared and formulated as emulsions. Emulsions are typically heterogeneous systems of one liquid dispersed in another in the form of droplets usually exceeding 0.1 µm in diameter (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199; Rosoff, in Pharmaceutical Dosage Forms, Lieberman, Rieger and Banker (Eds.), 1988, Marcel Dekker, Inc., New York, N.Y., Volume 1, p. 245; Block in Pharmaceutical Dosage Forms, Lieberman, Rieger and Banker (Eds.), 1988, Marcel Dekker, Inc., New York, N.Y., volume 2, p. 335; Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions may be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions may contain additional components in addition to the dispersed phases, and the active drug which may be present as a solution in either the aqueous phase, oily phase or itself as a separate phase. Pharmaceutical excipients such as emulsifiers, stabilizers, dyes, and anti-oxidants may also be present in emulsions as needed. Pharmaceutical emulsions may also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Either of the phases of the emulsion may be a semisolid or a solid, as is the case of emulsion-style ointment bases and creams. Other means of stabilizing emulsions entail the use of emulsifiers that may be incorporated into either phase of the emulsion. Emulsifiers may broadly be classified into four categories: synthetic surfactants, naturally occurring emulsifiers, absorption bases, and finely dispersed solids (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199).

Synthetic surfactants, also known as surface active agents, have found wide applicability in the formulation of emulsions and have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rieger, in Pharmaceutical Dosage Forms, Lieberman, Rieger and Banker (Eds.), 1988, Marcel Dekker, Inc., New York, N.Y., volume 1, p. 285; Idson, in Pharmaceutical Dosage Forms, Lieberman, Rieger and Banker (Eds.), Marcel Dekker, Inc., New York, N.Y., 1988, volume 1, p. 199). Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants may be classified into different classes based on the nature of the hydrophilic group: nonionic, anionic, cationic and amphoteric (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y. Rieger, in Pharmaceutical Dosage Forms, Lieberman, Rieger and Banker (Eds.), 1988, Marcel Dekker, Inc., New York, N.Y., volume 1, p. 285).

Naturally occurring emulsifiers used in emulsion formulations include lanolin, beeswax, phosphatides, lecithin and acacia. Absorption bases possess hydrophilic properties such that they can soak up water to form w/o emulsions yet retain their semisolid consistencies, such as anhydrous lanolin and hydrophilic petrolatum. Finely divided solids have also been used as good emulsifiers especially in combination with surfactants and in viscous preparations. These include polar inorganic solids, such as heavy metal hydroxides, nonswelling clays such as bentonite, attapulgite, hectorite, kaolin, montmorillonite, colloidal aluminum silicate and colloidal magnesium aluminum silicate, pigments and nonpolar solids such as carbon or glyceryl tristearate.

A large variety of non-emulsifying materials are also included in emulsion formulations and contribute to the properties of emulsions. These include fats, oils, waxes, fatty acids, fatty alcohols, fatty esters, humectants, hydrophilic colloids, preservatives and antioxidants (Block, in Pharmaceutical Dosage Forms, Lieberman, Rieger and Banker (Eds.), 1988, Marcel Dekker, Inc., New York, N.Y., volume 1, p. 335; Idson, in Pharmaceutical Dosage Forms, Lieberman, Rieger and Banker (Eds.), 1988, Marcel Dekker, Inc., New York, N.Y., volume 1, p. 199).

Hydrophilic colloids or hydrocolloids include naturally occurring gums and synthetic polymers such as polysaccharides (for example, acacia, agar, alginic acid, carrageenan, guar gum, karaya gum, and tragacanth), cellulose derivatives (for example, carboxymethylcellulose and carboxypropylcellulose), and synthetic polymers (for example, carbomers, cellulose ethers, and carboxyvinyl polymers). These disperse or swell in water to form colloidal solutions that stabilize emulsions by forming strong interfacial films around the dispersed-phase droplets and by increasing the viscosity of the external phase.

Since emulsions often contain a number of ingredients such as carbohydrates, proteins, sterols and phosphatides that may readily support the growth of microbes, these formulations often incorporate preservatives. Commonly used preservatives included in emulsion formulations include methyl paraben, propyl paraben, quaternary ammonium salts, benzalkonium chloride, esters of p-hydroxybenzoic acid, and boric acid. Antioxidants are also commonly added to emulsion formulations to prevent deterioration of the formulation. Antioxidants used may be free radical scavengers such as tocopherols, alkyl gallates, butylated hydroxyanisole, butylated hydroxytoluene, or reducing agents such as ascorbic acid and sodium metabisulfite, and antioxidant synergists such as citric acid, tartaric acid, and lecithin.

The application of emulsion formulations via dermatological, oral and parenteral routes and methods for their manufacture have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199). Emulsion formulations for oral delivery have been very widely used because of ease of formulation, as well as efficacy from an absorption and bioavailability standpoint (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245; Idson, in Pharmaceutical Dosage Forms, Lieberman, Rieger and Banker (Eds.), 1988, Marcel Dekker, Inc., New York, N.Y., volume 1, p. 199). Mineral-oil base laxatives, oil-soluble vitamins and high fat nutritive preparations are among the materials that have commonly been administered orally as o/w emulsions.

In one embodiment of the present invention, the compositions of iRNAs and nucleic acids are formulated as microemulsions. A microemulsion may be defined as a system of water, oil and amphiphile which is a single optically isotropic and thermodynamically stable liquid solution (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Rosoff, in Pharmaceutical Dosage Forms, Lieberman, Rieger and Banker (Eds.), 1988, Marcel Dekker, Inc., New York, N.Y., volume 1, p. 245). Typically microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotropically clear dispersions of two immiscible liquids that are stabilized by interfacial films of surface-active molecules (Leung and Shah, in: Controlled Release of Drugs: Polymers and Aggregate Systems, Rosoff, M., Ed., 1989, VCH Publishers, New York, pages 185-215). Microemulsions commonly are prepared via a combination of three to five components that include oil, water, surfactant, cosurfactant and electrolyte. Whether the microemulsion is of the water-in-oil (w/o) or an oil-in-water (o/w) type is dependent on the properties of the oil and surfactant used and on the structure and geometric packing of the polar heads and hydrocarbon tails of the surfactant molecules (Schott, in Remington's Pharmaceutical Sciences, Mack Publishing Co., Easton, Pa., 1985, p. 271).

The phenomenological approach utilizing phase diagrams has been extensively studied and has yielded a comprehensive knowledge, to one skilled in the art, of how to formulate microemulsions (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245; Block, in Pharmaceutical Dosage Forms, Lieberman, Rieger and Banker (Eds.), 1988, Marcel Dekker, Inc., New York, N.Y., volume 1, p. 335). Compared to conventional emulsions, microemulsions offer the advantage of solubilizing water-insoluble drugs in a formulation of thermodynamically stable droplets that are formed spontaneously.

Surfactants used in the preparation of microemulsions include, but are not limited to, ionic surfactants, non-ionic surfactants, Brij 96, polyoxyethylene oleyl ethers, polyglycerol fatty acid esters, tetraglycerol monolaurate (ML310), tetraglycerol monooleate (MO310), hexaglycerol monooleate (PO310), hexaglycerol pentaoleate (PO500), decaglycerol monocaprate (MCA750), decaglycerol monooleate (MO750), decaglycerol sequioleate (SO750), decaglycerol decaoleate (DAO750), alone or in combination with cosurfactants. The cosurfactant, usually a short-chain alcohol such as ethanol, 1-propanol, and 1-butanol, serves to increase the interfacial fluidity by penetrating into the surfactant film and consequently creating a disordered film because of the void space generated among surfactant molecules. Microemulsions may, however, be prepared without the use of cosurfactants and alcohol-free self-emulsifying microemulsion systems are known in the art. The aqueous phase may typically be, but is not limited to, water, an aqueous solution of the drug, glycerol, PEG300, PEG400, polyglycerols, propylene glycols, and derivatives of ethylene glycol. The oil phase may include, but is not limited to, materials such as Captex 300, Captex 355, Capmul MCM, fatty acid esters, medium chain (C8-C12) mono, di, and tri-glycerides, polyoxyethylated glyceryl fatty acid esters, fatty alcohols, polyglycolized glycerides, saturated polyglycolized C8-C10 glycerides, vegetable oils and silicone oil.

Microemulsions are particularly of interest from the standpoint of drug solubilization and the enhanced absorption of drugs. Lipid based microemulsions (both o/w and w/o) have been proposed to enhance the oral bioavailability of drugs, including peptides (see e.g., U.S. Pat. Nos. 6,191,105; 7,063,860; 7,070,802; 7,157,099; Constantinides et al., Pharmaceutical Research, 1994, 11, 1385-1390; Ritschel, Meth. Find. Exp. Clin. Pharmacol., 1993, 13, 205). Microemulsions afford advantages of improved drug solubilization, protection of drug from enzymatic hydrolysis, possible enhancement of drug absorption due to surfactant-induced alterations in membrane fluidity and permeability, ease of preparation, ease of oral administration over solid dosage forms, improved clinical potency, and decreased toxicity (see e.g., U.S. Pat. Nos. 6,191,105; 7,063,860; 7,070,802; 7,157,099; Constantinides et al., Pharmaceutical Research, 1994, 11, 1385; Ho et al., J. Pharm. Sci., 1996, 85, 138-143). Often microemulsions may form spontaneously when their components are brought together at ambient temperature. This may be particularly advantageous when formulating thermolabile drugs, peptides or iRNAs. Microemulsions have also been effective in the transdermal delivery of active components in both cosmetic and pharmaceutical applications. It is expected that the microemulsion compositions and formulations of the present invention will facilitate the increased systemic absorption of iRNAs and nucleic acids from the gastrointestinal tract, as well as improve the local cellular uptake of iRNAs and nucleic acids.

Microemulsions of the present invention may also contain additional components and additives such as sorbitan monostearate (Grill 3), Labrasol, and penetration enhancers to improve the properties of the formulation and to enhance the absorption of the iRNAs and nucleic acids of the present invention. Penetration enhancers used in the microemulsions of the present invention may be classified as belonging to one of five broad categories—surfactants, fatty acids, bile salts, chelating agents, and non-chelating non-surfactants (Lee et al., Critical Reviews in Therapeutic Drug Carrier Systems, 1991, p. 92). Each of these classes has been discussed above.

Penetration Enhancers

In one embodiment, the present invention employs various penetration enhancers to effect the efficient delivery of nucleic acids, particularly iRNAs, to the skin of animals. Most drugs are present in solution in both ionized and nonionized forms. However, usually only lipid soluble or lipophilic drugs readily cross cell membranes. It has been discovered that even non-lipophilic drugs may cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers may be classified as belonging to one of five broad categories, i.e., surfactants, fatty acids, bile salts, chelating agents, and non-chelating non-surfactants (see e.g., Malmsten, M. Surfactants and polymers in drug delivery, Informa Health Care, New York, N.Y., 2002; Lee et al., Critical Reviews in Therapeutic Drug Carrier Systems, 1991, p. 92). Each of the above mentioned classes of penetration enhancers are described below in greater detail.

Surfactants:

In connection with the present invention, surfactants (or "surface-active agents") are chemical entities which, when dissolved in an aqueous solution, reduce the surface tension of the solution or the interfacial tension between the aqueous solution and another liquid, with the result that absorption of iRNAs through the mucosa is enhanced. In addition to bile salts and fatty acids, these penetration enhancers include, for example, sodium lauryl sulfate, polyoxyethylene-9-lauryl ether and polyoxyethylene-20-cetyl ether) (see e.g., Malmsten, M. Surfactants and polymers in drug delivery, Informa Health Care, New York, N.Y., 2002; Lee et al., Critical Reviews in Therapeutic Drug Carrier Systems, 1991, p. 92); and perfluorochemical emulsions, such as FC-43. Takahashi et al., J. Pharm. Pharmacol., 1988, 40, 252).

Fatty Acids:

Various fatty acids and their derivatives which act as penetration enhancers include, for example, oleic acid, lauric acid, capric acid (n-decanoic acid), myristic acid, palmitic acid, stearic acid, linoleic acid, linolenic acid, dicaprate, tricaprate, monoolein (1-monooleoyl-rac-glycerol), dilaurin, caprylic acid, arachidonic acid, glycerol 1-monocaprate, 1-dodecylazacycloheptan-2-one, acylcarnitines, acylcholines, $C_{1-20}$ alkyl esters thereof (e.g., methyl, isopropyl and t-butyl), and mono- and di-glycerides thereof (i.e., oleate, laurate, caprate, myristate, palmitate, stearate, linoleate, etc.) (see e.g., Touitou, E., et al. Enhancement in Drug Delivery, CRC Press, Danvers, Mass., 2006; Lee et al., Critical Reviews in Therapeutic Drug Carrier Systems, 1991, p. 92; Muranishi, Critical Reviews in Therapeutic Drug Carrier Systems, 1990, 7, 1-33; El Hariri et al., J. Pharm. Pharmacol., 1992, 44, 651-654).

Bile Salts:

The physiological role of bile includes the facilitation of dispersion and absorption of lipids and fat-soluble vitamins (see e.g., Malmsten, M. Surfactants and polymers in drug delivery, Informa Health Care, New York, N.Y., 2002; Brunton, Chapter 38 in: Goodman & Gilman's The Pharmacological Basis of Therapeutics, 9th Ed., Hardman et al. Eds., McGraw-Hill, New York, 1996, pp. 934-935). Various natural bile salts, and their synthetic derivatives, act as penetration enhancers. Thus the term "bile salts" includes any of the naturally occurring components of bile as well as any of their synthetic derivatives. Suitable bile salts include, for example, cholic acid (or its pharmaceutically acceptable sodium salt, sodium cholate), dehydrocholic acid (sodium dehydrocholate), deoxycholic acid (sodium deoxycholate), glucholic acid (sodium glucholate), glycholic acid (sodium glycocholate), glycodeoxycholic acid (sodium glycodeoxycholate), taurocholic acid (sodium taurocholate), taurodeoxycholic acid (sodium taurodeoxycholate), chenodeoxycholic acid (sodium chenodeoxycholate), ursodeoxycholic acid (UDCA), sodium tauro-24,25-dihydro-fusidate (STDHF), sodium glycodihydrofusidate and polyoxyethylene-9-lauryl ether (POE) (see e.g., Malmsten, M. Surfactants and polymers in drug delivery, Informa Health Care, New York, N.Y., 2002; Lee et al., Critical Reviews in Therapeutic Drug Carrier Systems, 1991, page 92; Swinyard, Chapter 39 In: Remington's Pharmaceutical Sciences, 18th Ed., Gennaro, ed., Mack Publishing Co., Easton, Pa., 1990, pages 782-783; Muranishi, Critical Reviews in Therapeutic Drug Carrier Systems, 1990, 7, 1-33; Yamamoto et al., J. Pharm. Exp. Ther., 1992, 263, 25; Yamashita et al., J. Pharm. Sci., 1990, 79, 579-583).

Chelating Agents:

Chelating agents, as used in connection with the present invention, can be defined as compounds that remove metallic ions from solution by forming complexes therewith, with the result that absorption of iRNAs through the mucosa is enhanced. With regards to their use as penetration enhancers in the present invention, chelating agents have the added advantage of also serving as DNase inhibitors, as most characterized DNA nucleases require a divalent metal ion for catalysis and are thus inhibited by chelating agents (Jarrett, J. Chromatogr., 1993, 618, 315-339). Suitable chelating agents include but are not limited to disodium ethylenediaminetetraacetate (EDTA), citric acid, salicylates (e.g., sodium salicylate, 5-methoxysalicylate and homovanilate), N-acyl derivatives of collagen, laureth-9 and N-amino acyl derivatives of β-diketones (enamines) (see e.g., Katdare, A. et al., Excipient development for pharmaceutical, biotechnology, and drug delivery, CRC Press, Danvers, Mass., 2006; Lee et al., Critical Reviews in Therapeutic Drug Carrier Systems, 1991, page 92; Muranishi, Critical Reviews in Therapeutic Drug Carrier Systems, 1990, 7, 1-33; Buur et al., J. Control Rel., 1990, 14, 43-51).

Non-Chelating Non-Surfactants:

As used herein, non-chelating non-surfactant penetration enhancing compounds can be defined as compounds that demonstrate insignificant activity as chelating agents or as surfactants but that nonetheless enhance absorption of iRNAs through the alimentary mucosa (see e.g., Muranishi, Critical Reviews in Therapeutic Drug Carrier Systems, 1990, 7, 1-33). This class of penetration enhancers include, for example, unsaturated cyclic ureas, 1-alkyl- and 1-alkenylazacyclo-alkanone derivatives (Lee et al., Critical Reviews in Therapeutic Drug Carrier Systems, 1991, page 92); and non-steroidal anti-inflammatory agents such as diclofenac sodium, indomethacin and phenylbutazone (Yamashita et al., J. Pharm. Pharmacol., 1987, 39, 621-626).

Agents that enhance uptake of iRNAs at the cellular level may also be added to the pharmaceutical and other compositions of the present invention. For example, cationic lipids, such as lipofectin (Junichi et al, U.S. Pat. No. 5,705,188), cationic glycerol derivatives, and polycationic molecules, such as polylysine (Lollo et al., PCT Application WO 97/30731), are also known to enhance the cellular uptake of dsRNAs. Examples of commercially available transfection reagents include, for example Lipofectamine™ (Invitrogen; Carlsbad, Calif.), Lipofectamine 2000™ (Invitrogen; Carlsbad, Calif.), 293Fectin™ (Invitrogen; Carlsbad, Calif.), Cellfectin™ (Invitrogen; Carlsbad, Calif.), DMRIE-C™ (Invitrogen; Carlsbad, Calif.), FreeStyle™ MAX (Invitrogen; Carlsbad, Calif.), Lipofectamine™ 2000 CD (Invitrogen; Carlsbad, Calif.), Lipofectamine™ (Invitrogen; Carlsbad, Calif.), RNAiMAX (Invitrogen; Carlsbad, Calif.), Oligofectamine™ (Invitrogen; Carlsbad, Calif.), Optifect™ (Invitrogen; Carlsbad, Calif.), X-tremeGENE Q2 Transfection Reagent (Roche; Grenzacherstrasse, Switzerland), DOTAP Liposomal Transfection Reagent (Grenzacherstrasse, Switzerland), DOSPER Liposomal Transfection Reagent (Grenzacherstrasse, Switzerland), or Fugene (Grenzacherstrasse, Switzerland), Transfectam® Reagent (Promega; Madison, Wis.), TransFast™ Transfection Reagent (Promega; Madison, Wis.), Tfx™-20 Reagent (Promega; Madison, Wis.), Tfx™-50 Reagent (Promega; Madison, Wis.), DreamFect™ (OZ Biosciences; Marseille, France), EcoTransfect (OZ Biosciences; Marseille, France), TransPass$^a$ D1 Transfection Reagent (New England Biolabs; Ipswich, Mass., USA), LyoVec™/LipoGen™ (Invivogen; San Diego, Calif., USA), PerFectin Transfection Reagent (Genlantis; San Diego, Calif., USA), NeuroPORTER Transfection Reagent (Genlantis; San Diego, Calif., USA), GenePORTER Transfection reagent (Genlantis; San Diego, Calif., USA), GenePORTER 2 Transfection reagent (Genlantis; San Diego, Calif., USA), Cytofectin Transfection Reagent (Genlantis; San Diego, Calif., USA), BaculoPORTER Transfection Reagent (Genlantis; San Diego, Calif., USA), TroganPORTERT™ transfection Reagent (Genlantis; San Diego, Calif., USA), RiboFect (Bioline; Taunton, Mass., USA), PlasFect (Bioline; Taunton, Mass., USA), UniFECTOR (B-Bridge International; Mountain View, Calif., USA), SureFECTOR (B-Bridge International; Mountain View, Calif., USA), or HiFect™ (B-Bridge International, Mountain View, Calif., USA), among others.

Other agents may be utilized to enhance the penetration of the administered nucleic acids, including glycols such as ethylene glycol and propylene glycol, pyrrols such as 2-pyrrol, azones, and terpenes such as limonene and menthone.

Carriers

Certain compositions of the present invention also incorporate carrier compounds in the formulation. As used herein, "carrier compound" or "carrier" can refer to a nucleic acid, or analog thereof, which is inert (i.e., does not possess biological activity per se) but is recognized as a nucleic acid by in vivo processes that reduce the bioavailability of a nucleic acid having biological activity by, for example, degrading the biologically active nucleic acid or promoting its removal from circulation. The coadministration of a nucleic acid and a carrier compound, typically with an excess of the latter substance, can result in a substantial reduction of the amount of nucleic acid recovered in the liver, kidney or other extracirculatory reservoirs, presumably due to competition between the carrier compound and the nucleic acid for a common receptor. For example, the recovery of a partially phosphorothioate dsRNA in hepatic tissue can be reduced when it is coadministered with polyinosinic acid, dextran sulfate, polycytidic acid or 4-acetamido-4' isothiocyano-stilbene-2,2'-disulfonic acid (Miyao et al., DsRNA Res. Dev., 1995, 5, 115-121; Takakura et al., DsRNA & Nucl. Acid Drug Dev., 1996, 6, 177-183.

Excipients

In contrast to a carrier compound, a "pharmaceutical carrier" or "excipient" is a pharmaceutically acceptable solvent, suspending agent or any other pharmacologically inert vehicle for delivering one or more nucleic acids to an animal. The excipient may be liquid or solid and is selected, with the planned manner of administration in mind, so as to provide for the desired bulk, consistency, etc., when combined with a nucleic acid and the other components of a given pharmaceutical composition. Typical pharmaceutical carriers include, but are not limited to, binding agents (e.g., pregelatinized maize starch, polyvinylpyrrolidone or hydroxypropyl methylcellulose, etc.); fillers (e.g., lactose and other sugars, microcrystalline cellulose, pectin, gelatin, calcium sulfate, ethyl cellulose, polyacrylates or calcium hydrogen phosphate, etc.); lubricants (e.g., magnesium stearate, talc, silica, colloidal silicon dioxide, stearic acid, metallic stearates, hydrogenated vegetable oils, corn starch, polyethylene glycols, sodium benzoate, sodium acetate, etc.); disintegrants (e.g., starch, sodium starch glycolate, etc.); and wetting agents (e.g., sodium lauryl sulphate, etc).

Pharmaceutically acceptable organic or inorganic excipients suitable for non-parenteral administration which do not deleteriously react with nucleic acids can also be used to formulate the compositions of the present invention. Suitable pharmaceutically acceptable carriers include, but are not limited to, water, salt solutions, alcohols, polyethylene glycols, gelatin, lactose, amylose, magnesium stearate, talc, silicic acid, viscous paraffin, hydroxymethylcellulose, polyvinylpyrrolidone and the like.

Formulations for topical administration of nucleic acids may include sterile and non-sterile aqueous solutions, non-aqueous solutions in common solvents such as alcohols, or solutions of the nucleic acids in liquid or solid oil bases. The solutions may also contain buffers, diluents and other suitable additives. Pharmaceutically acceptable organic or inorganic excipients suitable for non-parenteral administration which do not deleteriously react with nucleic acids can be used.

Suitable pharmaceutically acceptable excipients include, but are not limited to, water, salt solutions, alcohol, polyethylene glycols, gelatin, lactose, amylose, magnesium stearate, talc, silicic acid, viscous paraffin, hydroxymethylcellulose, polyvinylpyrrolidone and the like.

Other Components

The compositions of the present invention may additionally contain other adjunct components conventionally found in pharmaceutical compositions, at their art-established usage levels. Thus, for example, the compositions may contain additional, compatible, pharmaceutically-active materials such as, for example, antipruritics, astringents, local anesthetics or anti-inflammatory agents, or may contain additional materials useful in physically formulating various dosage forms of the compositions of the present invention, such as dyes, flavoring agents, preservatives, antioxidants, opacifiers, thickening agents and stabilizers. However, such materials, when added, should not unduly interfere with the biological activities of the components of the compositions of the present invention. The formulations can be sterilized and, if desired, mixed with auxiliary agents, e.g., lubricants, preservatives, stabilizers, wetting agents, emulsifiers, salts for influencing osmotic pressure, buffers, colorings, flavorings and/or aromatic substances and the like which do not deleteriously interact with the nucleic acid(s) of the formulation.

Aqueous suspensions may contain substances that increase the viscosity of the suspension including, for example, sodium carboxymethylcellulose, sorbitol and/or dextran. The suspension may also contain stabilizers.

In some embodiments, pharmaceutical compositions featured in the invention include (a) one or more iRNA compounds and (b) one or more biologic agents which function by a non-RNAi mechanism. Examples of such biologic agents include agents that interfere with an interaction of ALAS1 and at least one ALAS1 binding partner.

Toxicity and therapeutic efficacy of such compounds can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and it can be expressed as the ratio LD50/ED50. Compounds that exhibit high therapeutic indices are typical.

The data obtained from cell culture assays and animal studies can be used in formulating a range of dosage for use in humans. The dosage of compositions featured in the invention lies generally within a range of circulating concentrations that include the ED50 with little or no toxicity. The dosage may vary within this range depending upon the dosage form employed and the route of administration utilized. For any compound used in the methods featured in the invention, the therapeutically effective dose can be estimated initially from cell culture assays. A dose may be formulated in animal models to achieve a circulating plasma concentration range of the compound or, when appropriate, of the polypeptide product of a target sequence (e.g., achieving a decreased concentration of the polypeptide) that includes the IC50 (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

In addition to their administration, as discussed above, the iRNAs featured in the invention can be administered in combination with other known agents effective in treatment of diseases or disorders related to ALAS1 expression. In any event, the administering physician can adjust the amount and timing of iRNA administration on the basis of results observed using standard measures of efficacy known in the art or described herein.

Methods for Treating Diseases Related to Expression of an ALAS1 Gene

The invention relates in particular to the use of an iRNA targeting ALAS1 to inhibit ALAS1 expression and/or to treat a disease, disorder, or pathological process that is related to ALAS1 expression.

As used herein, "a disorder related to ALAS1 expression," a "disease related to ALAS1 expression, a "pathological process related to ALAS1 expression," or the like includes any condition, disorder, or disease in which ALAS1 expression is altered (e.g., elevated), the level of one or more porphyrins is altered (e.g., elevated), the level or activity of one or more enzymes in the heme biosynthetic pathway (porphyrin pathway) is altered, or other mechisms that lead to pathological changes in the heme biosynthetic pathway. For example, an iRNA targeting an ALAS1 gene, or a combination thereof, may be used for treatment of conditions in which levels of a porphyrin or a porphyrin precursor (e.g., ALA or PBG) are elevated (e.g., certain porphyrias), or conditions in which there are defects in the enzymes of the heme biosynthetic pathway (e.g., certain porphyrias). Disorders related to ALAS1 expression include, for example, X-linked sideroblastic anemia (XLSA), ALA deyhdratase deficiency porphyria (Doss porphyria), acute intermittent porphyria (AIP), congenital erythropoietic porphyria, prophyria cutanea tarda, hereditary coproporphyria (coproporphyria), variegate porphyria, erythropoietic protoporphyria (EPP), and transient erythroporphyria of infancy.

As used herein, a "subject" to be treated according to the methods described herein, includes a human or non-human animal, e.g., a mammal. The mammal may be, for example, a rodent (e.g., a rat or mouse) or a primate (e.g., a monkey). In some embodiments, the subject is a human.

In some embodiments, the subject is suffering from a disorder related to ALAS1 expression (e.g., has been diagnosed with a porphyria or has suffered from one or more symptoms of porphyria and is a carrier of a mutation associated with porphyria) or is at risk of developing a disorder related to ALAS1 expression (e.g., a subject with a family history of porphyria, or a subject who is a carrier of a genetic mutation associated with porphyria).

Classifications of porphyrias, including acute hepatic porphyrias, are described, e.g., in Balwani, M. & Desnick, R. J., *Blood*, 120(23), published online as Blood First Edition paper, July 12, 102; DOI 10.1182/blood-2012-05-423186. As described in Balwain & Desnick, acute intermittent porphyria (AIP) hereditary coproporphyria (HCP), variegate porphyria (VP) are autosomal dominant porphyrias and ALA deyhdratase deficiency porphyria (ADP) is autosomal recessive. In rare cases, AIP, HCP, and VP occur as homozygous dominant forms. In addition, there is a rare homozygous recessive form of porphyria cutanea tarda (PCT), which is the single hepatic cutaneous porphyria, and is also known as hepatoerythropoietic porphyria. The clinical and laboratory features of these porphyrias are described in Table 11 below.

In some embodiments, the porphyria is a dual porphyria, e.g., at least two porphyrias. In some embodiments, the dual porphyria comprises two or more porphyrias selected from acute intermittent porphyria (AIP) hereditary coproporphyria (HCP), variegate porphyria (VP), and ALA deyhdratase deficiency porphyria (ADP).

In some embodiments, the porphyria is a homozygous dominant hepatic porphyria (e.g., homozygous dominant AIP, HCP, or VP) or hepatoerythropoietic porphyria, In some embodiments, the porphyria is AIP, HCP, VP, or hepatoerythropoietic porphyria, or a combination thereof (e.g., a dual porphyria). In embodiments, the AIP, HCP, or VP is either heterozygous dominant or homozygous dominant.

In embodiments, the subject has or is at risk for developing a porphyria, e.g., ADP, and shows an elevated level (e.g., an elevated urine level) of ALA and/or coproporphyrin III. In embodiments, the subject has or is at risk for developing a porphyria, e.g., ADP, and shows an elevated level of erythrocyte Zn-protoporphyrin.

In embodiments, the subject has or is at risk for developing a porphyria, e.g., AIP, and shows an elevated level (e.g., an elevated urine level) of ALA, PBG, and/or uroporphyrin.

In embodiments, the subject has or is at risk for developing a porphyria, e.g., HCP, and shows an elevated level (e.g., an elevated urine level) of ALA, PBG, and/or

TABLE 11

Human hepatic porphyrias: clinical and laboratory features

| Porphyria | Deficient enzyme | Inheritance | Principal symptoms, NV or CP | Enzyme activity, % of normal | Increased porphyrin precursors and/or porphyrins* | | |
|---|---|---|---|---|---|---|---|
| | | | | | Erythrocytes | Urine | Stool |
| Acute hepatic porphyrias | | | | | | | |
| ADP | ALA-dehydratase | AR | NV | ~5 | Zn-protoporphyrin | ALA, coproporphyrin III | — |
| AIP | HMB-synthase | AD | NV | ~50 | — | ALA, PBG, uroporphyrin | — |
| HCP | COPRO-oxidase | AD | NV and CP | ~50 | — | ALA, PBG, coproporphyrin III | coproporphyrin III |
| VP | PROTO-oxidase | AD | NV and CP | ~50 | — | ALA, PBG coproporphyrin III | coproporphyrin III, protoporphyrin |
| Hepatic cutaneous porphyrias | | | | | | | |
| PCT | URO-decarboxylase | Sporadic or AD | CP | <20 | — | uroporphyrin, 7-carboxylate porphyrin | uroporphyrin, 7-carboxylate porphyrin |

AR indicates autosomal recessive;
AD, autosomal dominant;
NV, neurovisceral;
CP, cutaneous photosensitivity; and
—, not applicable.
*Increases that may be important for diagnosis.

In some embodiments, the subject has or is at risk for developing a porphyria, e.g., a hepatic porphyria, e.g., AIP, HCP, VP, ADP, or hepatoerythropoietic porphyria.

In some embodiments, the porphyria is an acute hepatic porphyria, e.g., an acute hepatic porphyria iselected from acute intermittent porphyria (AIP), hereditary coproporphyria (HCP), variegate porphyria (VP), and ALA deyhdratase deficiency porphyria (ADP).

coproporphyrin III. In embodiments, the subject has or is at risk for developing a porphyria, e.g., HCP, and shows an elevated level (e.g., an elevated stool level) of coproporphyrin III.

In embodiments, the subject has or is at risk for developing a porphyria, e.g., VP, and shows an elevated level (e.g., an elevated urine level) of ALA, PBG, and/or coproporphyrin III.

In embodiments, the subject has or is at risk for developing a porphyria, e.g., HCP, and shows an elevated level (e.g., an elevated stool level) of coproporphyrin III and/or protoporphyrin.

In embodiments, the subject has or is at risk for developing a porphyria, e.g., PCT, (e.g., hepatoerythropoietic porphyria) and shows an elevated level (e.g., an elevated urine level) of uroporphyrin and/or 7-carboxylate porphyrin. In embodiments, the subject has or is at risk for developing a porphyria, e.g., PCT, (e.g., hepatoerythropoietic porphyria) and shows an elevated level (e.g., an elevated stool level) of uroporphyrin and/or 7-carboxylate porphyrin.

A mutation associated with porphyria includes any mutation in a gene encoding an enzyme in the heme biosynthetic pathway (porphyrin pathway) or a gene which alters the expression of a gene in the heme biosynthetic pathway. In many embodiments, the subject carries one or more mutations in an enzyme of the porphyrin pathway (e.g., a mutation in ALA deydratase or PBG deaminase). In some embodiments, the subject is suffereing from an acute porphyria (e.g., AIP, ALA deydratase deficiency porphyria).

In some cases, patients with an acute hepatic porphyria (e.g., AIP), or patients who carry mutations associated with an acute hepatic porphyria (e.g., AIP) but who are asymptomatic, have elevated ALA and/or PBG levels compared with healthy individuals. See, e.g., Floderus, Y. et al, Clinical Chemistry, 52(4): 701-707, 2006; Sardh et al., Clinical Pharmacokinetics, 46(4): 335-349, 2007. In such cases, the level of ALA and/or PBG can be elevated even when the patient is not having, or has never had, an attack. In some such cases, the patient is otherwise completely asymptomatic. In some such cases, the patient suffers from pain, e.g., neuropathic pain, which can be chronic pain (e.g., chronic neuropathic pain). In some cases, the patient has a neuropathy. In some cases, the patient has a progressive neuropathy.

In some embodiments, the subject to be treated according to the methods described herein has an elevated level of a porphyrin or a porphyrin precursor, e.g., ALA and/or PBG. Levels of a porphyrin or a porphyrin precursor can be assessed using methods known in the art or methods described herein. For example, methods of assessing uring and plasma ALA and PBG levels, as well as urine and plasma porphyrin levels, are disclosed in Floderus, Y. et al, Clinical Chemistry, 52(4): 701-707, 2006; and Sardh et al., Clinical Pharmacokinetics, 46(4): 335-349, 2007, the entire contents of which are hereby incorporated in their entirety.

In some embodiments, the subject is an animal model of a porphyria, e.g., a mouse model of a porphyria (e.g., a mutant mouse as described in Lindberg et al. Nature Genetics, 12: 195-199, 1996). In some embodiments, the subject is a human, e.g., a human who has or is at risk for developing a porphyria, as described herein. In some embodiments, the subject is not having an acute attack of porphyria. In some embodiments, the subject has never had an attack. In some embodiments, the patient suffers from chronic pain. In some embodiments, the patient has nerve damage. In embodiments, the subject has EMG changes and/or changes in nerve conduction velocity. In some embodiments, the subject is asymptomatic. In some embodiments, the subject is at risk for developing a porphyria (e.g., carries a gene mutation associated with a porphyria) and is asymptomatic. In some embodiments, the subject has previously had an acute attack but is asymptomatic at the time of treatment.

In some embodiments, the subject is at risk for developing a porphyria and is treated prophylactically to prevent the development of a porphyria. In some embodiments the subject has an elevated level of a porphyrin or a porphyrin precursor, e.g., ALA and/or PBG. In some embodiments, the prophylactic treatment begins at puberty. In some embodiments the treatment lowers the level (e.g., the plasma level or the urine level) of a porphyrin or a porphyrin precursor, e.g., ALA and/or PBG. In some embodiments, the treatment prevents the development of an elevated level of a porphyrin or a porphyrin precursor, e.g., ALA and/or PBG. In some embodiments, the treatment prevents the development of, or decreases the frequency or severity of, a symptom associated with a porphyria, e.g., pain or nerve damage.

In some embodiments, the level of a porphyrin or a porphyrin precursor, e.g., ALA or PBG, is elevated, e.g., in a sample of plasma or urine from the subject. In some embodiments, the level of a porphyrin or a porphyrin precursor, e.g., ALA or PBG, in the subject is assessed based on the absolute level of the porphyrin or the porphyrin precursor, e.g., ALA or PBG in a sample from the subject. In some embodiments, the level of a porphyrin or a porphyrin precursor, e.g., ALA or PBG, in the subject is assessed based on the relative level of the porphyrin or porphyrin precursor, e.g., ALA or PBG, in a sample from the subject. In some embodiments, the relative level is relative to the level of another protein or compound, e.g., the level of creatinine, in a sample from the subject. In some embodiments, the sample is a urine sample. In some embodiments, the sample is a plasma sample. In some embodiments, the sample is a stool sample.

An elevated level of a porphyrin or a porphyrin precursor, e.g., ALA and/or PBG, can be established, e.g., by showing that the subject has a level of a porphyrin or a porphyrin precursor, e.g., ALA and/or PBG (e.g., a plasma or urine level of ALA and/or PBG) that is greater than, or greater than or equal to, a reference value. A physician with expertise in the treatment of porphyrias would be able to determine whether the level of a porphyrin or a porphyrin precursor, (e.g., ALA and/or PBG) is elevated, e.g., for the purpose of diagnosing a porphyria or for determining whether a subject is at risk for developing a porphyria, e.g., a subject may be predisposed to an acute attack or to pathology associated with a porphyria, such as, e.g., chronic pain (e.g., neuropathic pain) and neuropathy (e.g., progressive neuropathy).

As used herein, a "reference value" refers to a value from the subject when the subject is not in a disease state, or a value from a normal or healthy subject, or a value from a reference sample or population, e.g., a group of normal or healthy subjects (e.g., a group of subjects that does not carry a mutation associated with a porphyria and/or a group of subjects that does not suffer from symptoms associated with a porphyria).

In some embodiments, the reference value is a pre-disease level in the same individual. In some embodiments, the reference value is a level in a reference sample or population. In some embodiments, the reference value is the mean or median value in a reference sample or population. In some embodiments, the reference value the value that is two standard deviations above the mean in a reference sample or population. In some embodiments, the reference value is the value that is 2.5, 3, 3.5, 4, 4.5, or 5 standard deviations above the mean in a reference sample or population.

In some embodiments, wherein the subject has an elevated level of a porphyrin or a porphyrin precursor, e.g., ALA and/or PBG, the subject has a level of ALA and/or PBG that is at least 10%, 20%, 30%, 40%, 50%, 60%, 70%, 80%, or 90% higher than a reference value. In some embodiments, the subject has a level of a porphyrin or a porphyrin precursor, e.g., ALA and/or PBG, that is at least 2, 3, 4, 5, 6, 7, 8, 9, or 10 fold higher than a reference value.

In some embodiments, the reference value is an upper reference limit. As used herein, an "upper reference limit" refers to a level that is the upper limit of the 95% confidence interval for a reference sample or population, e.g., a group of normal (e.g., wild type) or healthy individuals, e.g., individuals who do not carry a genetic mutation associated with a porphyria and/or individuals who do not suffer from a porphyria. Accordingly, a lower reference limit refers to a level that is the lower limit of the same 95% confidence interval.

In some embodiments wherein the subject has an elevated level, e.g., a plasma level or a urine level, of a porphyrin or a porphyrin precursor, e.g., ALA or PBG, the level is greater than or equal to 2 times, 3 times, 4 times, or 5 times that of a reference value, e.g., an upper reference limit. In some embodiments, the subject has a urine level of a porphyrin or a porphyrin precursor, e.g., ALA or PBG, that is greater than 4 times that of an upper reference limit.

In some embodiments, the reference value is a value provided in Floderus, Y. et al, Clinical Chemistry, 52(4): 701-707, 2006 or Sardh et al., Clinical Pharmacokinetics, 46(4): 335-349, 2007. In some embodiments, the reference value is a value provided in Table 1 of Sardh et al.

In some embodiments, the subject is a human and has a urine level of PBG that is greater than or equal to 4.8 mmol/mol creatinine. In certain embodiments, the subject is a human and has a urine level of PBG that is greater than, or greater than or equal to, about 3, 4, 5, 6, 7, or 8 mmol/mol creatinine.

In embodiments, the reference value for plasma PBG is 0.12 μmol/L. In embodiments, the subject is a human and has a plasma PBG level that is greater than, or greater than or equal to, 0.10 μmol/L, 0.12 μmol/L, 0.24 μmol/L, 0.36 μmol/L, 0.48 μmol/L, or 0.60 μmol/L. In embodiments, the subject is a human and has a plasma level of PBG that is greater than, or greater than or equal to, 0.48 μmol/L.

In embodiments, the reference value for urine PBG is 1.2 mmol/mol creatinine. In embodiments, the subject is a human and has a urine PBG level that is greater than, or greater than or equal to, 1.0 mmol/mol creatinine, 1.2 mmol/mol creatinine, 2.4 mmol/mol creatinine, 3.6 mmol/mol creatinine, 4.8 mmol/mol creatinine, or 6.0 mmol/mol creatinine. In embodiments, the subject is a human and has a urine level of PBG that is greater than, or greater than or equal to, 4.8 mmol/mol creatinine.

In embodiments, the reference value for plasma ALA is 0.12 μmol/L. In embodiments, the subject is a human and has a plasma ALA level that is greater than, or greater than or equal to, 0.10 μmol/L, 0.12 μmol/L, 0.24 μmol/L, 0.36 μmol/L, 0.48 μmol/L, or 0.60 μmol/L. In embodiments, the subject is a human and has a plasma ALA level that is greater than, or greater than or equal to 0.48 μmol/L.

In embodiments, the reference value for urine ALA is 3.1 mmol/mol creatinine. In embodiments, the subject is a human and has a urine ALA level that is greater than, or greater than or equal to, 2.5 mmol/mol creatinine, 3.1 mmol/mol creatinine, 6.2 mmol/mol creatinine, 9.3 mmol/mol creatinine, 12.4 mmol/mol creatinine, or 15.5 mmol/mol creatinine.

In embodiments, the reference value for plasma porphyrin is 10 nmol/L. In embodiments, the subject is a human and has a plasma porphyrin level that is greater than, or greater than or equal to, 10 nmol/L. In embodiments, the subject is a human and has a plasma porphyrin level that is greater than, or greater than or equal to, 8, 10, 15, 20, 25, 30, 35, 40, 45, or 50 nmol/L. the subject is a human and has a plasma porphyrin level that is greater than, or greater than or equal to 40 nmol/L. In embodiments, the reference value for urine porphyrin is 25 μmol/mol creatinine. In embodiments, the subject is a human and has a urine porphyrin level that is greater than, or greater than or equal to, 25 μmol/mol creatinine. In embodiments, the subject is a human and has a urine porphyrin level that is greater than, or equal to, 20, 25, 30, 35, 40, 45, 50, 55, 60, 65, 70, 75, or 80 μmol/mol creatinine.

In some embodiments, the subject has a level, e.g., a plasma level or a urine level, of a porphyrin or a porphyrin precursor, e.g., ALA or PBG, that is greater than that of 99% of individuals in a sample of healthy individuals.

In some embodiments, the subject has a level, e.g., a plasma level or a urine level, of ALA or PBG that is greater than two standard deviations above the mean level in a sample of healthy individuals.

In some embodiments, the subject has a urine level of ALA that is 1.6 or more times that of the mean level in a normal subject (e.g., a subject that does not carry a mutation associated with a porphyria). In some embodiments, the subject has a plasma level of ALA that is 2 or 3 times that of the mean level in a normal subject. In some embodiments, the subject has a urine level of PBG that is four or more times that of the mean level in a normal subject. In some embodiments, the subject has a plasma level of PBG that is four or more times that of the mean level in a normal subject.

In some embodiments, the method is effective to decrease the level of a porphyrin or a porphyrin precursor, e.g., ALA and/or PBG. In embodiments, the method is effective to produce a predetermined reduction in the elevated level of the porphyrin or porphyrin precursor, e.g., ALA or PBG. In some embodiments, the predetermined reduction is a decrease of at least 10%, 20%, 30%, 40%, or 50%. In some embodiments, the predetermined reduction is a reduction that is effective to prevent or ameliorate symptoms, e.g., pain or recurring attacks.

In some embodiments, the predetermined reduction is a reduction that is at least 1, 2, 3, or more standard deviations, wherein the standard deviation is determined based on the values from a reference sample, e.g., a reference sample as described herein.

In some embodiments, the predetermined reduction is a reduction that brings the level of the porphyrin or porphyrin precursor to a level that is less than, or to a level that is less than or equal to, a reference value (e.g., a reference value as described herein).

In some embodiments, the subject to be treated according to the methods described suffers from pain, e.g., chronic pain. In some embodiments, the subject has or is at risk for developing a porphyria, e.g. an acute hepatic porphyria, e.g., AIP. In embodiments, the method is effective to treat the pain, e.g., by reducing the severity of the pain or curing the pain. In embodiments, the method is effective to decrease or prevent nerve damage.

In some embodiments, the subject to be treated according to the methods described herein (a) has an elevated level of ALA and/or PBG and (b) suffers from pain, e.g., chronic pain. In embodiments, the method is effective to decrease an elevated level of ALA and/or PBG and/or to treat the pain, e.g., by reducing the severity of the pain or curing the pain.

In some embodiments, the subject is an animal that serves as a model for a disorder related to ALAS1 expression.

In some embodiments the subject is an animal that serves as a model for porphyria (e.g., a genetically modified animal with one or more mutations. In some embodiments, the porphyria is AIP and the subject is an animal model of AIP. In one such embodiment, the subject is a genetically modified mouse that is deficient in porphobilinogen deaminase, such as, for example, the mouse described in Lindberg et al., *Nature Genetics,* 12:195-199, 1996, or the homozygous R167Q mouse described in Yasuda, M., Yu, C. Zhang, J., Clayero, S., Edelmann, W., Gan, L., Phillips, J. D., & Desnick, R. J. Acute intermittent porphyria: A severely affected knock-in mouse that mimics the human homozygous dominant phenotype. (Abstract of Presentation on Oct. 14, 2011 at the American Society of Human Genetics; Program No. 1308F; accessed online on Apr. 4, 2012 at ichg2011.org/cgi-bin/showdetail.pl?absno=21167); both of these references are hereby incorporated herein in their entirety. Several knock-in models for mutations causing homozygous dominant AIP in humans have been generated. The mutations employed include, e.g., R167Q, R173Q, and R173W in PBG deaminase. Viable homozygotes included the R167Q/R176Q and R167Q/R173Q, both of which exhibit constitutively elevated ALA and PBG levels analogous to the phenotype in human homozygous dominant AIP; in some embodiments, such a viable homozygous AIP mouse model is the subject.

In one embodiment, a subject to be treated according to the methods described herein, (e.g., a human subject or patient), is at risk of developing, or has been diagnosed, with a disorder related to ALAS1 expression, e.g. a porphyria. In some embodiments, the subject is a subject who has suffered one or more acute attacks of one or more porphyric symptoms. In other embodiments, the subject is a subject who has suffered chronically from one or more symptoms of porphyria (e.g., pain, e.g., neuropathic pain and or neuropathy, e.g., progressive neuropathy). In some embodiments, the subject carries a genetic alteration (e.g., a mutation) as described herein but is otherwise asymptomatic. In some embodiments, the subject has previously been treated with a heme product (e.g., hemin, heme arginate, or heme albumin), as described herein.

In some embodiments, a subject (e.g., a subject with a porphyria, such as, e.g., AIP) to be treated according to the methods described herein has recently experienced or is currently experiencing a prodrome. In some such embodiments, the subject is administered a combination treatment, e.g., an iRNA as described herein, and one or more additional treatments known to be effective against porphyria (e.g., glucose and/or a heme product such as hemin, as described herein) or its associated symptoms.

In one embodiment, an iRNA as described herein is administered in combination with glucose or dextrose. For example, 10-20% dextrose in normal saline may be provided intravenously. Typically, when glucose is administered, at least 300 g of 10% glucose is administered intravenously daily. The iRNA (e.g., an iRNA in an LNP formulation) may also be administered intravenously, as part of the same infusion that is used to administer the glucose or dextrose, or as a separate infusion that is administered before, concurrently, or after the administration of the glucose or dextrose. In some embodiments, the iRNA is administered via a different route of administration (e.g., subcutaneously). In yet another embodiment, the iRNA is administered in combination with total parenteral nutrition. The iRNA may be administered before, concurrent with, or after the administration of total parenteral nutrition.

In one embodiment, the iRNA is administered in combination with a heme product (e.g., hemin, heme arginate, or heme albumin). In a further embodiment, the iRNA is administered in combination with a heme product and glucose, a heme product and dextrose, or a heme product and total parenteral nutrition.

A "prodrome," as used herein, includes any symptom that the individual subject has previously experienced immediately prior to developing an acute attack. Typical symptoms of a prodrome include, e.g., abdominal pain, nausea, headaches, psychological symptoms (e.g., anxiety), restlessness and/or insomnia. In some embodiments, the subject experiences pain (e.g., abdominal pain and/or a headache) during the prodrome. In some embodiments, the subject experiences nausea during the prodrome. In some embodiments, the subject experiences psychological symptoms (e.g., anxiety) during the prodrome. In some embodiments, the subject becomes restless and/or suffers from insomnia during the prodrome.

An acute "attack" of porphyria involves the onset of one or more symptoms of porphyria, typically in a patient who carries a mutation associated with porphyria (e.g., a mutation in a gene that encodes an enzyme in the porphyrin pathway).

In certain embodiments, administration of an ALAS1 iRNA results in a decrease in the level of one or more porphyrins or porphyrin precursors, as described herein (e.g., ALA and/or PBG). The decrease may be measured relative to any appropriate control or reference value. For example, the decrease in the level of one or more porphyrins or porphyrin precursors may be established in an individual subject, e.g., as a decrease of at least 5%, 10%, 15%, 20%, 25%, 30%, 35%, 40%, 45%, 50% or more compared with the level prior to treatment (e.g., immediately prior to treatment). A decrease in the level of a porphyrin precursor, a porphyrin, or or a porphyrin metabolite may be measured using any method known in the art. For example, the level of PBG and/or ALA in urine or plasma may be assessed, using the Watson-Schwartz test, ion exchange chromatography, or high-performance liquid chromatography-mass spectrometry. See, e.g., Thunell (1993).

In some embodiments, administration of an ALAS1 siRNA is effective to reduce the level of ALA and/or PBG in the subject. The level of ALA or PBG in the subject can be assessed, e.g., based on the absolute level of ALA or PBG, or based on the relative level of ALA or PBG (e.g., relative to the level of another protein or compound, e.g., the level of creatinine) in a sample from the subject. In some embodiments, the sample is a urine sample. In some embodiments, the sample is a plasma sample.

In certain embodiments, an iRNA that targets ALAS1 is administered in combination one or more additional treatments, e.g., another treatment known to be effective in treating porphyria or symptoms of porphyria. For example, the other treatment may be glucose (e.g., IV glucose) or a heme product (e.g., hemin, heme arginate, or heme albumin). The additional treatment(s) may be administered before, after, or concurrent with the administration of iRNA.

The iRNA and an additional therapeutic agent can be administered in combination in the same composition, e.g., intravenously, or the additional therapeutic agent can be administered as part of a separate composition or by another method described herein.

In some embodiments, administration of iRNA, or administration of iRNA in combination one or more additional treatments (e.g., glucose, dextrose or the like), decreases the frequency of acute attacks (e.g., by preventing acute attacks so that they no longer occur, or by reducing the number of attacks that occur in a certain time period, e.g., fewer attacks occur per year). In some such embodiments, the iRNA is administered according to a regular dosing regimen, e.g., daily, weekly, biweekly, or monthly.

In some embodiments, the iRNA is administered after an acute attack of porphyria. In some such embodiments, the iRNA is in a composition, e.g. a composition comprising a lipid formulation, e.g. an LNP formulation.

In some embodiments, the iRNA is administered during an acute attack of porphyria. In some such embodiments, the iRNA is in a composition, e.g. a composition comprising a lipid formulation (e.g., an LNP formulation) or a composition comprising a GalNAc conjugate.

In some embodiments, administration of an ALAS1 siRNA is effective to lessen the severity of the attack (e.g., by ameliorating one or more signs or symptoms associated with the attack). In some embodiments, administration of an ALAS1 siRNA is effective to shorten the duration of an attack. In some embodiments, administration of an ALAS1 siRNA is effective to stop an attack. In some embodiments, the iRNA is administered prophylactically to prevent an acute attack of porphyria. In some such embodiments, the iRNA is in the form of a GalNAc conjugate, e.g., in a composition comprising a GalNAc conjugate. In some embodiments, the prophylactic administration is before, during, or after exposure to or occurrence of a precipitating factor. In some embodiments, the subject is at risk of developing porphyria.

In some embodiments, the siRNA is administered during a prodrome. In some embodiments, the prodrome is characterized by pain (e.g., headache and/or abdominal pain), nausea, psychological symptoms (e.g., anxiety), restlessness and/or insomnia.

In some embodiments, the siRNA is administered during a particular phase of the menstrual cycle, e.g., during the luteal phase.

In some embodiments, administration of an ALAS1 siRNA is effective to prevent attacks (e.g., recurrent attacks that are associated with a prodrome and/or with a precipitating factor, e.g., with a particular phase of the menstrual cycle, e.g., the luteal phase). In some embodiments, administration of an ALAS1 siRNA is effective to reduce the frequency of attacks. In embodiments, administration of an ALAS1 siRNA is effective to lessen the severity of the attack (e.g., by ameliorating one or more signs or symptoms associated with the attack). In some embodiments, administration of an ALAS1 siRNA is effective to shorten the duration of an attack. In some embodiments, administration of an ALAS1 siRNA is effective to stop an attack.

In some embodiments administration of an ALAS1 siRNA is effective to prevent or decrease the frequency or severity of pain, e.g., neuropathic pain.

In some embodiments administration of an ALAS1 siRNA is effective to prevent or decrease the frequency or severity of neuropathy Effects of administration of an ALAS1 siRNA can be established, for example, by comparison with an appropriate control. For example, a decrease in the frequency of acute attacks, as well as a decrease in the level of one or more porphyrins or porphyrin precursors, may be established, for example, in a group of patients with AIP, as a decreased frequency compared with an appropriate control group. A control group (e.g., a group of similar individuals or the same group of individuals in a crossover design) may include, for example, an untreated population, a population that has been treated with a conventional treatment for porphyria (e.g., a conventional treatment for AIP may include glucose, hemin, or both); a population that has been treated with placebo, or a non-targeting iRNA, optionally in combination with one or more conventional treatments for porphyria (e.g., glucose, e.g., IV glucose), and the like.

A subject "at risk" of developing porphyria, as used herein, includes a subject with a family history of porphyria and/or a history of one or more recurring or chronic porphyric symptoms, and/or a subject who carries a genetic alteration (e.g., a mutation) in a gene encoding an enzyme of the heme biosynthetic pathway, and a subject who carries a genetic alteration, e.g., a mutation. known to be associated with porphyria.

In embodiments, the alteration, e.g., the mutation, makes an individual susceptible to an acute attack (e.g., upon exposure to a precipitating factor, e.g., a drug, dieting or other precipitating factor, e.g., a precipitating factor as disclosed herein). In embodiments, the alteration, e.g., the mutation, is associated with elevated levels of a porphyrin or a porphyrin precursor (e.g., ALA and/or PBG). In embodiments, the alteration, e.g., the mutation, is associated with chronic pain (e.g., chronic neuropathic pain) and/or neuropathy (e.g., progressive neuropathy). In embodiments, the, the alteration, e.g., the mutation, is associated with changes in EMG and/or nerve conduction velocities.

In embodiments, the alteration is a mutation in the ALAS1 gene. In embodiments, the alteration is a mutation in the ALAS1 gene promoter, or in regions upstream or downstream from the ALAS1 gene. In embodiments, the alteration is a mutation in transcription factors or other genes that interact with ALAS1. In embodiments, the alteration is an alteration, e.g., a mutation, in a gene that encodes an enzyme in the heme biosynthetic pathway.

In some embodiments, the subject has an genetic alteration as described herein (e.g., a genetic mutation known to be associated with a porphyria). In some such embodiments, the subject has an elevated level (e.g., urine or plasma level) of ALA and/or PBG. In some such embodiments, the subject does not have an elevated level of ALA and/or PBG. In embodiments, the subject has a genetic alteration as described herein and has other symptoms, e.g., chronic pain, EMG changes, changes in nerve conduction velocity, and/or other symptoms associated with a porphyria. In embodiments, the subject has a genetic alteration but does not suffer from acute attacks.

In embodiments, the subject has a mutation associated with AIP, HCP, VP, or ADP.

In some embodiments, the porphyria is AIP. In some such embodiments, the subject has an alteration, e.g., at least one mutation, in the PBG deaminase gene. Many PBG deaminase mutations are known in the art, for example, as reported in Hrdinka, M. et al. Physiological Research, 55 (Suppl 2):S119-136 (2006). In some embodiments, the subject is heterozygous for a PBG deaminase mutation. In other embodiments, the subject is homozygous for a PBG deaminase mutation. A homozygous subject may carry two identical mutations or two different mutations in the PBG deaminase gene.

In some embodiments, the porphyria is HCP. In some such embodiments, the subject has an alteration, e.g., at least one mutation, in the gene that encodes the enzyme coproporphyrinogen III oxidase.

In some embodiments, the porphyria is VP. In some such embodiments, the subject has an alteration, e.g., at least one mutation, in the gene that encodes protoporphrinogen oxidase.

In embodiments, the porphyria is ADP, e.g., autosomal recessive ADP. In some such embodiments, the subject has an alteration, e.g., at least one mutation, in the gene that encodes ALA deydratase.

Methods of treatment provided herein may serve to ameliorate one or more symptoms associated with porphyria, to reduce the frequency of attacks associated with porphyria, to reduce the likelihood that an attack of one or more symptoms associated with porphyria will occur upon exposure to a precipitating factor, or to reduce the risk of developing conditions associated with porphyria (e.g., neuropathy (e.g., progressive neuropathy), hepatocellular cancer). Additionally, the methods provided herein may serve to decrease the level of one or more porphyrin precursors, porphyrins and/or related porphyrin products or metabolites. The level of a porphyrin precursor or a porhyrin may be measured in any biological sample, such as, e.g., urine, blood, feces, cerebrospinal fluid, or a tissue sample. The sample may be present within a subject or may be obtained or extracted from the subject. In some embodiments, the porphyria is AIP, and the level of PBG and/or ALA is decreased. In some embodiments, the porphyrin product or metabolite is porphobilin, porphobilinogen, or uroporphyrin. A decrease in the level of a porphyrin product or metabolite may be measured using any method known in the art. For example, the level of PBG and/or ALA in urine or plasma may be assessed, using the Watson-Schwartz test, ion exchange chromatography, or high-performance liquid chromatography-mass spectrometry. See, e.g., Thunell (1993).

Methods described herein may also serve to reduce chronically elevated levels of porphyrin precursors (e.g., ALA and/or PBG) in subjects suffering from a porphyria (e.g., an acute hepatic porphyria, e.g., AIP) or at risk for developing a porphyria. Methods for assessing plasma and urine levels (e.g., chronically elevated levels) of porphyrin precursors include, e.g., HPLC-mass spectrometry and ion-exchange chromatography. The levels of porphyrin precursors may be expressed as the level relative to another protein or compound, e.g., creatinine. See, e.g., Floderus, Y. et al, Clinical Chemistry, 52(4): 701-707, 2006; Sardh et al., Clinical Pharmacokinetics, 46(4): 335-349, 2007

A "precipitating factor" as used herein, refers to an endogenous or exogenous factor that may induce an acute attack of one or more symptoms associated with porphyria. Precipitating factors include fasting (or other forms of reduced or inadequate caloric intake, due to crash diets, long-distance athletics, etc.), metabolic stresses (e.g., infections, surgery, international air travel, and psychological stress), endogenous hormones (e.g., progesterone), cigarette smoking, lipid-soluble foreign chemicals (including, e.g., chemicals present in tobacco smoke, certain prescription drugs, organic solvents, biocides, components in alcoholic beverages), endocrine factors (e.g., reproductive hormones (women may experience exacerbations during the premenstrual period), synthetic estrogens, progesterones, ovulation stimulants, and hormone replacement therapy). See, for example, Thunell (1993). Common precipitating factors include cytochrome P450 inducing drugs and phenobarbital.

Symptoms associated with porphyria may include abdominal pain or cramping, headaches, effects caused by nervous system abnormalities, and light sensitivity, causing rashes, blistering, and scarring of the skin (photodermatitis). In certain embodiments, the porphyria is AIP. Symptoms of AIP include gastrointestinal symptoms (e.g., severe and poorly localized abdominal pain, nausea/vomiting, constipation, diarrhea, ileus), urinary symptoms (dysuria, urinary retention/incontinence, or dark urine), neurologic symptoms (e.g., sensory neuropathy, motor neuropathy (e.g., affecting the cranial nerves and/or leading to weakness in the arms or legs), seizures, neuropathic pain, progressive neuropathy, headaches, neuropsychiatric symptoms (e.g., mental confusion, anxiety, agitation, hallucination, hysteria, delirium, apathy, depression, phobias, psychosis, insomnia, somnolence, coma), autonomic nervous system involvement (resulting e.g., in cardiovascular sysmptoms such as tachycardia, hypertension, and/or arrhythmias, as well as other symptoms, such as, e.g., increased circulating catecholamine levels, sweating, restlessness, and/or tremor), dehydration, and electrolyte abnormalities.

In some embodiments, an iRNA targeting ALAS1 is administered together with (e.g., before, after, or concurrent with) another treatment that may serve to alleviate one or more of the above symptoms. For example, abdominal pain may be treated, e.g., with narcotic analgesics, seizures may be treated, e.g., with anti-seizure medications, nausea/vomiting may be treated, e.g., with phenothiazines, and tachycardia/hypertension may be treated, e.g., with beta blockers.

The term "decrease" (or "increase") is intended to refer to a measurable change, e.g., a statistically significant change. The change may be, for example, at least 5%, 10%, 20%, 30%, 40%, 50% or more change (e.g., decrease (or increase) relative to a reference value, e.g., a reference where no iRNA is provided).

The invention further relates to the use of an iRNA or a pharmaceutical composition thereof, e.g., for treating a disorder related to ALAS1 expression, in combination with other pharmaceuticals and/or other therapeutic methods, e.g., with known pharmaceuticals and/or known therapeutic methods, such as, for example, those which are currently employed for treating the disorder. In one embodiment, the iRNA or pharmaceutical composition thereof can be administered in conjunction with a heme product (e.g., hemin, heme arginate, or heme albumin, as described herein) and/or in conjunction with intravenous glucose infusions. In some embodiments, the iRNA or pharmaceutical composition thereof is used prophylactically, e.g., to prevent or ameliorate symptoms of an anticipated attack of acute porphyria. The prophylactic use may be timed according to the exposure or anticipated exposure of the subject to a precipitating factor. As described herein, a precipitating factor may be any endogenous or exogenous factor known to precipitate an acute attack. For example, the premenstrual phase is an endogenous precipitating factor, and a cytochrome P450 inducing drug is an exogenous precipitating factor.

The effective amount for the treatment of a disorder related to ALAS1 expression (e.g., a porphyria such as AIP) depends on the type of disorder to be treated, the severity of the symptoms, the subject being treated, the sex, age and general condition of the subject, the mode of administration and so forth. For any given case, an appropriate "effective amount" can be determined by one of ordinary skill in the art using routine experimentation. It is well within the ability of one skilled in the art to monitor efficacy of treatment or prevention by measuring any one of such parameters, or any combination of parameters. In connection with the administration of an iRNA targeting ALAS1 or pharmaceutical composition thereof, "effective against" a disorder related to ALAS1 expression indicates that administration in a clinically appropriate manner results in a beneficial effect, e.g., for an individual patient or for at least a fraction of patients, e.g., a statistically significant fraction of patients. Beneficial effects include, e.g., prevention of or reduction of symptoms or other effects. For example, beneficial effects include, e.g., an improvement (e.g., decrease in the severity or frequency) of symptoms, a reduction in the severity or frequency of attacks, a reduced risk of developing associated disease (e.g., neuropathy (e.g., progressive neuropathy), hepatocellular cancer), an improved ability to tolerate a precipitating factor, an improvement in quality of life, a reduction in the expression of ALAS1, a reduction in a level (e.g., a plasma or urine level) of a porphyrin or a porphyrin precursor (e.g., ALA and/or PBG) or other effect generally recognized as positive by medical doctors familiar with treating the particular type of disorder.

A treatment or preventive effect is evident when there is an improvement, e.g., a statistically significant improvement in one or more parameters of disease status, or by a failure to worsen or to develop symptoms where they would otherwise be anticipated. As an example, a favorable change of at least 10% in a measurable parameter of disease, e.g., at least 20%, 30%, 40%, 50% or more can be indicative of effective treatment. Efficacy for a given iRNA drug or formulation of that drug can also be judged using an experimental animal model for the given disease as known in the art. When using an experimental animal model, efficacy of treatment is evidenced when a statistically significant reduction in a marker (e.g., plasma or urinary ALA or PBG) or symptom is observed.

Patients can be administered a therapeutic amount of iRNA. The therapeutic amount can be, e.g., 0.05-50 mg/kg. For example, the therapeutic amount can be 0.05, 0.1, 0.2, 0.3, 0.4, 0.5, 0.6, 0.7, 0.8, 0.9, 1.0, 1.5, 2.0, or 2.5, 3.0, 3.5, 4.0, 4.5, 5, 10, 15, 20, 25, 30, 35, 40, 45, or 50 mg/kg dsRNA.

In some embodiments, the iRNA is formulated as a lipid formulation, e.g., an LNP formulation as described herein. In some such embodiments, the therapeutic amount is 0.05-5 mg/kg, e.g., 0.05, 0.1, 0.2, 0.3, 0.4, 0.5, 0.6, 0.7, 0.8, 0.9, 1.0, 1.5, 2.0, 2.5, 3.0, 3.5, 4.0, 4.5, or 5.0 mg/kg dsRNA. In some embodiments, the lipid formulation, e.g., LNP formulation, is administered intravenously.

In some embodiments, the iRNA is administered by intravenous infusion over a period of time, such as over a 5 minute, 10 minute, 15 minute, 20 minute, or 25 minute period.

In some embodiments, the iRNA is in the form of a GalNAc conjugate as described herein. In some such embodiments, the therapeutic amount is 0.5-50 mg, e.g., 0.5, 0.6, 0.7, 0.8, 0.9, 1.0, 1.5, 2.0, 2.5, 3.0, 3.5, 4.0, 4.5, 5.0, 6, 7, 8, 9, 10, 15, 20, 25, 30, 35, 40, 45, or 50 mg/kg dsRNA. In some embodiments, the GalNAc conjugate is administered subcutaneously.

In some embodiments, the administration is repeated, for example, on a regular basis, such as, daily, biweekly (i.e., every two weeks) for one month, two months, three months, four months or longer. After an initial treatment regimen, the treatments can be administered on a less frequent basis. For example, after administration biweekly for three months, administration can be repeated once per month, for six months or a year or longer.

In some embodiments, the iRNA agent is administered in two or more doses. In some embodiments, the number or amount of subsequent doses is dependent on the achievement of a desired effect, e.g., suppression of a ALAS gene, reduction of a level of a porphyrin or porphyrin precursor (e.g., ALA and/or PBG), or the achievement of a therapeutic or prophylactic effect, e.g., reduction or prevention of one or more symptoms associated with porphyria (e.g., pain, e.g., neuropathic pain), and/or prevention of attacks or reduction in the frequency and/or severity of attacks associated with porphyria.

In some embodiments, the iRNA agent is administered according to a schedule. For example, the iRNA agent may be administered once per week, twice per week, three times per week, four times per week, or five times per week. In some embodiments, the schedule involves regularly spaced administrations, e.g., hourly, every four hours, every six hours, every eight hours, every twelve hours, daily, every 2 days, every 3 days, every 4 days, every 5 days, weekly, biweekly, or monthly. In embodiments, the iRNA agent is administered weekly or biweekly to achieve a desired effect, e.g., to decrease the level of ALA and/or PBG, to decrease pain, and/or to prevent acute attacks.

In embodiments, the schedule involves closely spaced administrations followed by a longer period of time during which the agent is not administered. For example, the schedule may involve an initial set of doses that are administered in a relatively short period of time (e.g., about every 6 hours, about every 12 hours, about every 24 hours, about every 48 hours, or about every 72 hours) followed by a longer time period (e.g., about 1 week, about 2 weeks, about 3 weeks, about 4 weeks, about 5 weeks, about 6 weeks, about 7 weeks, or about 8 weeks) during which the iRNA agent is not administered. In one embodiment, the iRNA agent is initially administered hourly and is later administered at a longer interval (e.g., daily, weekly, biweekly, or monthly). In another embodiment, the iRNA agent is initially administered daily and is later administered at a longer interval (e.g., weekly, biweekly, or monthly). In certain embodiments, the longer interval increases over time or is determined based on the achievement of a desired effect. In a specific embodiment, the iRNA agent is administered once daily during an acute attack, followed by weekly dosing starting on the eighth day of administration. In another specific embodiment, the iRNA agent is administered every other day during a first week followed by weekly dosing starting on the eighth day of administration.

In one embodiment, the iRNA agent is administered to prevent or reduce the severity or frequency of recurring attacks, e.g., cyclical attacks associated with a precipitating factor. In some embodiments, the precipitating factor is the menstrual cycle. In some embodiments, the iRNA is administered repeatedly, e.g., at regular intervals to prevent or reduce the severity or frequency of recurring attacks, e.g., cyclical attacks associated with a precipitating factor, e.g., the menstrual cycle, e.g., a particular phase of the menstrual cycle, e.g., the luteal phase. In some embodiments, the iRNA is administered during a particular phase of the menstrual cycle or based on hormone levels of the patient being treated (e.g., based on hormone levels that are associated with a particular phase of the menstrual cycle). In some embodiments, the iRNA is administered on one or more particular days of the menstrual cycle, e.g., on day 1, 2, 3, 4, 5, 6, 7, 8, 9, 10, 11, 12, 13, 14, 15, 16, 17, 18, 19, 20, 21, 22, 23, 24, 25, 26, 27, or on day 28 (or later day for subjects who have a longer menstrual cycle). In some embodiments, the iRNA is administered during the luteal phase, e.g., on one or more days between days 14-28 of the menstrual cycle (or later, in subjects who have a menstrual cycle longer than 28 days). In some embodiments, ovulation of the subject is assessed (e.g., using a blood or urine test that detects a hormone associated with ovulation, e.g., LH) and the iRNA is administered at a predetermined interval after ovulation. In some embodiments, the iRNA is administered immediately after ovulation. In some embodiments, the iRNA is administered 1, 2, 3, 4, 5, 6, 7, 8, 9, 10, 11, 12, 13, 14, 15, 16, 17, or 18 days after ovulation. Any of these schedules may optionally be repeated for one or more iterations. The number of iterations may depend on the achievement of a desired effect, e.g., the suppression of a ALAS1 gene and/or the achievement of a therapeutic or prophylactic effect, e.g., reduce or prevent one or more symptoms associated with porphyria, to reduce the frequency of attacks associated with porphyria.

In some embodiments, an initial dose of the iRNA agent is administered and the level of ALA or PBG is tested, e.g., 1-48 hours, e.g., 2, 4, 8, 12, or 24 hours following administration of the initial dose. In some embodiments, if the level of ALA and/or PBG has decreased (e.g., to achieve a predetermined reduction, e.g., a normalization), and/or if the symptoms associated with porphyria (e.g., pain) have improved (e.g., such that the patient is asymptomatic), no further dose is administered, whereas if the level of ALA and/or PBG has not decreased (e.g., has not achieved a predetermined reduction, e.g., has not normalized), a further dose of ALA or PBG is administered. In some embodiments, the further dose is administered 12, 24, 36, 48, 60, or 72 hours after the initial dose. In some embodiments, if the initial dose is not effective to decrease the level of ALA and/or PBG, the further dose is modified, e.g., increased to achieve a desired decrease (e.g., a predetermined reduction, e.g., a normalization) in ALA or PBG levels.

In some embodiments, the predetermined reduction is a decrease of at least 10%, 20%, 30%, 40%, or 50%. In some embodiments, the predetermined reduction is a reduction that is effective to prevent or ameliorate symptoms, e.g., pain, prodromal symptoms, or recurring attacks.

In some embodiments, the predetermined reduction is a reduction of at least 1, 2, 3, or more standard deviations, wherein the standard deviation is determined based on the values from a reference sample, e.g., a reference sample as described herein.

In some embodiments, the predetermined reduction is a reduction that brings the level of the porphyrin or porphyrin precursor to a level that is less than, or to a level that is less than or equal to, a reference value (e.g., a reference value as described herein).

As used herein, a "normalization" in ALA or PBG levels (or a "normal" or "normalized" level) refers to a level (e.g., a urine and/or plasma level) of either ALA, or PBG, or both, that is within the expected range for a healthy individual, an individual who is asymptomatic (e.g., an individual who does not experience pain and/or suffer from neuropathy), or an individual who does not have a mutation associated with a porphyria. For example, in some embodiments, a normalized level is within two standard deviations of the normal mean. In some embodiments, a normalized level is within normal reference limits, e.g., within the 95% confidence interval for an appropriate control sample, e.g., a sample of healthy individuals or individuals who do not carry a gene mutation associated with a porphyria. In some embodiments, the ALA and/or PBG level of the subject (e.g., the urine and/or plasma ALA and/or PBG level) is monitored at intervals, a further dose of the iRNA agent is administered when the level increases above the reference value Administration of the iRNA may reduce ALAS1 mRNA or protein levels, e.g., in a cell, tissue, blood, urine or other compartment of the patient by at least 10%, at least 15%, at least 20%, at least 25%, at least 30%, at least 40%, at least 50%, at least 60%, at least 70%, at least 80% or at least 90% or more. Administration of the iRNA may reduce levels of products associated with ALAS1 gene expression, e.g., levels of one or more porphyrins or porphyrin precursors (e.g., the level of ALA and/or PBG). Administration of the iRNA agent may also inhibit or prevent the upregulation of ALAS1 mRNA or protein levels during an acute attack of AIP.

Before administration of a full dose of the iRNA, patients can be administered a smaller dose, such as a 5% infusion dose, and monitored for adverse effects, such as an allergic reaction, or for elevated lipid levels or blood pressure. In another example, the patient can be monitored for unwanted effects.

Methods for Modulating Expression of an ALAS1 Gene

In yet another aspect, the invention provides a method for modulating (e.g., inhibiting or activating) the expression of an ALAS1 gene, e.g., in a cell or in a subject. In some embodiments, the cell is ex vivo, in vitro, or in vivo. In some embodiments, the cell is an erythroid cell or a hepatocyte. In some embodiments, the cell is in a subject (e.g., a mammal, such as, for example, a human). In some embodiments, the subject (e.g., the human) is at risk, or is diagnosed with a disease related to ALAS1 expression, as described above.

In one embodiment, the method includes contacting the cell with an iRNA as described herein, in an amount effective to decrease the expression of an ALAS1 gene in the cell. "Contacting," as used herein, includes directly contacting a cell, as well as indirectly contacting a cell. For example, a cell within a subject (e.g., an erythroid cell or a liver cell, such as a hepatocyte) may be contacted when a composition comprising an iRNA is administered (e.g., intravenously or subcutaneously) to the subject.

The expression of an ALAS1 gene may be assessed based on the level of expression of an ALAS1 mRNA, an ALAS1 protein, or the level of a parameter functionally linked to the level of expression of an ALAS1 gene (e.g., the level of a porphyrin or the incidence or severity of a symptom related to a porphyria). In some embodiments, the expression of ALAS1 is inhibited by at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, or at least 95%. In some embodiments, the iRNA has an $IC_{50}$ in the range of 0.001-0.01 nM, 0.001-0.10 nM, 0.001-1.0 nM, 0.001-10 nM, 0.01-0.05 nM, 0.01-0.50 nM, 0.02-0.60 nM, 0.01-1.0 nM, 0.01-1.5 nM, 0.01-10 nM. The $IC_{50}$ value may be normalized relative to an appropriate control value, e.g., the $IC_{50}$ of a non-targeting iRNA.

In some embodiments, the method includes introducing into the cell an iRNA as described herein and maintaining the cell for a time sufficient to obtain degradation of the mRNA transcript of an ALAS1 gene, thereby inhibiting the expression of the ALAS1 gene in the cell.

In one embodiment, the method includes administering a composition described herein, e.g., a composition comprising an iRNA that targets ALAS1, to the mammal such that expression of the target ALAS1 gene is decreased, such as for an extended duration, e.g., at least two, three, four days or more, e.g., one week, two weeks, three weeks, or four weeks or longer. In some embodiments, the decrease in expression of ALAS1 is detectable within 1 hour, 2 hours, 4 hours, 8 hours, 12 hours, or 24 hours of the first administration.

In another embodiment, the method includes administering a composition as described herein to a mammal such that expression of the target ALAS1 gene is increased by e.g., at least 10% compared to an untreated animal. In some embodiments, the activation of ALAS1 occurs over an extended duration, e.g., at least two, three, four days or more, e.g., one week, two weeks, three weeks, four weeks, or more. Without wishing to be bound by theory, an iRNA can activate ALAS1 expression by stabilizing the ALAS1 mRNA transcript, interacting with a promoter in the genome, and/or inhibiting an inhibitor of ALAS1 expression.

The iRNAs useful for the methods and compositions featured in the invention specifically target RNAs (primary or processed) of an ALAS1 gene. Compositions and methods for inhibiting the expression of an ALAS1 gene using iRNAs can be prepared and performed as described elsewhere herein.

In one embodiment, the method includes administering a composition containing an iRNA, where the iRNA includes a nucleotide sequence that is complementary to at least a part of an RNA transcript of the ALAS1 gene of the mammal to be treated. When the organism to be treated is a mammal such as a human, the composition may be administered by any means known in the art including, but not limited to oral, intraperitoneal, or parenteral routes, including intracranial (e.g., intraventricular, intraparenchymal and intrathecal), intravenous, intramuscular, subcutaneous, transdermal, airway (aerosol), nasal, rectal, and topical (including buccal and sublingual) administration.

In certain embodiments, the compositions are administered by intravenous infusion or injection. In some such embodiments, the compositions comprise a lipid formulated siRNA (e.g., an LNP formulation, such as an LNP11 formulation) for intravenous infusion. In particular embodiments, such compositions may be used to treat acute attacks of porphyria and/or for prophylaxis (e.g., to decrease the severity or frequency of attacks).

In other embodiments, the compositions are administered subcutaneously. In some such embodiments, the compositions comprise an iRNA conjugated to a GalNAc ligand. In particular embodiments, such compositions may be used to treat acute attacks of porphyria or for prophylaxis (e.g., to decrease the severity or frequency of attacks).

Methods for Decreasing a Level of a Porphyrin or Porphyrin Precursor

In another aspect, the invention provides a method for decreasing a level of a porphyrin or a porphyrin precursor, e.g., in a cell or in a subject.

In some embodiments, the cell is ex vivo, in vitro, or in vivo. In some embodiments, the cell is an erythroid cell or a hepatocyte. In some embodiments, the cell is a hepatocyte. In some embodiments, the cell is in a subject (e.g., a mammal, such as, for example, a human).

In some embodiments, the subject (e.g., the human) is at risk, or is diagnosed with a porphyria, as described herein. In some embodiments, the method is effective to treat a porphyria as described herein (e.g., by ameliorating one or more symptoms associated with a porphyria, reducing the frequency of attacks associated with a porphyria, reducing the likelihood that an attack of one or more symptoms associated with porphyria will occur upon exposure to a precipitating factor, or reducing the risk of developing conditions associated with a porphyria (e.g., neuropathy (e.g., progressive neuropathy), hepatocellular cancer). In one embodiment, the method includes contacting the cell with an RNAi, as described herein, in an amount sufficient to decrease the level of the porphyrin or porphyrin precursor (e.g., ALA or PBG) in the cell, or in another related cell or group of cells, or in the subject. "Contacting," as used herein, includes directly contacting a cell, as well as indirectly contacting a cell. For example, a cell within a subject (e.g., an erythroid cell or a liver cell, such as a hepatocyte) may be contacted when a composition comprising an RNAi is administered (e.g., intravenously or subcutaneously) to the subject. "Another related cell or group of cells," as used herein, includes any cell or group of cells in which the level of the porphyrin or porphyrin precursor decreases as a result of the contacting. For example, the cell may be part of a tissue present within a subject (e.g., a liver cell present within a subject), and contacting the cell within the subject (e.g., contacting one or more liver cells present within a subject) with the RNAi may result in a decrease in the level of the porphyrin or porphyrin precursor in another related cell or group of cells (e.g., nerve cells of the subject), or in a tissue or fluid of the subject (e.g., in the urine, blood, plasma, or cerebrospinal fluid of the subject).

In some embodiments, the porphyrin or porphyrin precursor is selected from the group consisting of δ-aminolevulinic acid (ALA), porphopilinogen (PBG), hydroxymethylbilane (HMB), uroporphyrinogen III, coproporphyrinogen III, protoporphrinogen IX, and protoporphyrin IX In some embodiments the porphyrin precursor is ALA. In some embodiments, the porphyrin precursor is PBG. In some embodiments, the method decreases the level of ALA and PBG. The level of a porphyrin or a porphyrin precursor may be measured as described herein and as known in the art.

Unless otherwise defined, all technical and scientific terms used herein have the same meaning as commonly understood by one of ordinary skill in the art to which this invention belongs. Although methods and materials similar or equivalent to those described herein can be used in the practice or testing of the iRNAs and methods featured in the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

EXAMPLES

Example 1 siRNA Synthesis

Source of Reagents

Where the source of a reagent is not specifically given herein, such reagent may be obtained from any supplier of reagents for molecular biology at a quality/purity standard for application in molecular biology.

Oligonucleotide Synthesis.

All oligonucleotides are synthesized on an AKTAoligopilot synthesizer. Commercially available controlled pore glass solid support (dT-CPG, 500 Å, Prime Synthesis) and RNA phosphoramidites with standard protecting groups, 5'-O-dimethoxytrityl N6-benzoyl-2'-t-butyldimethylsilyl-adenosine-3'-O—N,N'-diisopropyl-2-cyanoethylphosphoramidite, 5'-O-dimethoxytrityl-N4-acetyl-2'-t-butyldimethylsilyl-cytidine-3'-O—N,N'-diisopropyl-2-cyanoethylphosphoramidite, 5'-O-dimethoxytrityl-N2-isobutryl-2'-t-butyldimethylsilyl-guanosine-3'-O—N,N'-diisopropyl-2-cyanoethylphosphoramidite, and 5'-O-dimethoxytrityl-2'-t-butyldimethylsilyl-uridine-3'-O—N,N'-diisopropyl-2-cyanoethylphosphoramidite (Pierce Nucleic Acids Technologies) were used for the oligonucleotide synthesis. The 2'-F phosphoramidites, 5'-O-dimethoxytrityl-N4-acetyl-2'-fluoro-cytidine-3'-O—N,N'-diisopropyl-2-cyanoethyl-phosphoramidite and 5'-O-dimethoxytrityl-2'-fluoro-uridine-3'-O—N,N'-diisopropyl-2-cyanoethyl-phosphoramidite are purchased from (Promega). All phosphoramidites are used at a concentration of 0.2M in acetonitrile ($CH_3CN$) except for guanosine which is used at 0.2M concentration in 10% THF/ANC (v/v). Coupling/recycling time of 16 minutes is used. The activator is 5-ethyl thiotetrazole (0.75M, American International Chemicals); for the PO-oxidation iodine/water/pyridine is used and for the PS-oxidation PADS (2%) in 2,6-lutidine/ACN (1:1 v/v) is used.

3'-ligand conjugated strands are synthesized using solid support containing the corresponding ligand. For example, the introduction of cholesterol unit in the sequence is performed from a hydroxyprolinol-cholesterol phosphoramidite. Cholesterol is tethered to trans-4-hydroxyprolinol via a 6-aminohexanoate linkage to obtain a hydroxyprolinol-cholesterol moiety. 5'-end Cy-3 and Cy-5.5 (fluorophore) labeled iRNAs are synthesized from the corresponding Quasar-570 (Cy-3) phosphoramidite are purchased from Biosearch Technologies. Conjugation of ligands to 5'-end and or internal position is achieved by using appropriately protected ligand-phosphoramidite building block. An extended 15 min coupling of 0.1 M solution of phosphoramidite in anhydrous $CH_3CN$ in the presence of 5-(ethylthio)-1H-tetrazole activator to a solid-support-bound oligonucleotide. Oxidation of the internucleotide phosphite to the phosphate is carried out using standard iodine-water as reported (1) or by treatment with tert-butyl hydroperoxide/acetonitrile/water (10:87:3) with 10 min oxidation wait time conjugated oligonucleotide. Phosphorothioate is introduced by the oxidation of phosphite to phosphorothioate by using a sulfur transfer reagent such as DDTT (purchased from AM Chemicals), PADS and or Beaucage reagent. The cholesterol phosphoramidite is synthesized in house and used at a concentration of 0.1 M in dichloromethane. Coupling time for the cholesterol phosphoramidite is 16 minutes.

Deprotection I (Nucleobase Deprotection)

After completion of synthesis, the support is transferred to a 100 mL glass bottle (VWR). The oligonucleotide is cleaved from the support with simultaneous deprotection of base and phosphate groups with 80 mL of a mixture of ethanolic ammonia [ammonia:ethanol (3:1)] for 6.5 h at 55° C. The bottle is cooled briefly on ice and then the ethanolic ammonia mixture is filtered into a new 250-mL bottle. The CPG is washed with 2×40 mL portions of ethanol/water (1:1 v/v). The volume of the mixture is then reduced to ~30 mL by roto-vap. The mixture is then frozen on dry ice and dried under vacuum on a speed vac.

Deprotection II (Removal of 2'-TBDMS Group)

The dried residue is resuspended in 26 mL of triethylamine, triethylamine trihydrofluoride (TEA•3HF) or pyridine-HF and DMSO (3:4:6) and heated at 60° C. for 90 minutes to remove the tert-butyldimethylsilyl (TBDMS) groups at the 2' position. The reaction is then quenched with 50 mL of 20 mM sodium acetate and the pH is adjusted to 6.5. Oligonucleotide is stored in a freezer until purification.

Analysis

The oligonucleotides are analyzed by high-performance liquid chromatography (HPLC) prior to purification and selection of buffer and column depends on nature of the sequence and or conjugated ligand.

HPLC Purification

The ligand-conjugated oligonucleotides are purified by reverse-phase preparative HPLC. The unconjugated oligonucleotides are purified by anion-exchange HPLC on a TSK gel column packed in house. The buffers are 20 mM sodium phosphate (pH 8.5) in 10% $CH_3CN$ (buffer A) and 20 mM sodium phosphate (pH 8.5) in 10% $CH_3CN$, 1M NaBr (buffer B). Fractions containing full-length oligonucleotides are pooled, desalted, and lyophilized. Approximately 0.15 OD of desalted oligonucleotidess are diluted in water to 150 μL and then pipetted into special vials for CGE and LC/MS analysis. Compounds are then analyzed by LC-ESMS and CGE.

siRNA Preparation

For the general preparation of siRNA, equimolar amounts of sense and antisense strand are heated in 1×PBS at 95° C. for 5 min and slowly cooled to room temperature. Integrity of the duplex is confirmed by HPLC analysis.

Nucleic acid sequences are represented below using standard nomenclature, and specifically the abbreviations of Table 1.

TABLE 1

Abbreviations of nucleotide monomers used in nucleic acid sequence representation. It will be understood that these monomers, when present in an oligonucleotide, are mutually linked by 5'-3'-phosphodiester bonds.

| Abbreviation | Nucleotide(s) |
| --- | --- |
| A | Adenosine-3'-phosphate |
| Ab | beta-L-adenosine-3'-phosphate |
| Abs | beta-L-adenosine-3'-phosphorothioate |
| Af | 2'-fluoroadenosine-3'-phosphate |
| Afs | 2'-fluoroadenosine-3'-phosphorothioate |
| As | adenosine-3'-phosphorothioate |
| C | cytidine-3'-phosphate |
| Cb | beta-L-cytidine-3'-phosphate |
| Cbs | beta-L-cytidine-3'-phosphorothioate |
| Cf | 2'-fluorocytidine-3'-phosphate |
| Cfs | 2'-fluorocytidine-3'-phosphorothioate |
| (Chd) | 2'-O-hexadecyl-cytidine-3'-phosphate |
| (Chds) | 2'-O-hexadecyl-cytidine-3'-phosphorothioate |
| Cs | cytidine-3'-phosphorothioate |
| G | guanosine-3'-phosphate |
| Gb | beta-L-guanosine-3'-phosphate |
| Gbs | beta-L-guanosine-3'-phosphorothioate |
| Gf | 2'-fluoroguanosine-3'-phosphate |
| Gfs | 2'-fluoroguanosine-3'-phosphorothioate |
| Gs | guanosine-3'-phosphorothioate |
| T | 5'-methyluridine-3'-phosphate |
| Tb | beta-L-thymidine-3'-phosphate |
| Tbs | beta-L-thymidine-3'-phosphorothioate |
| Tf | 2'-fluoro-5-methyluridine-3'-phosphate |
| Tfs | 2'-fluoro-5-methyluridine-3'-phosphorothioate |
| Ts | 5-methyluridine-3'-phosphorothioate |
| U | Uridine-3'-phosphate |

TABLE 1-continued

Abbreviations of nucleotide monomers used in nucleic acid sequence representation. It will be understood that these monomers, when present in an oligonucleotide, are mutually linked by 5'-3'-phosphodiester bonds.

| Abbreviation | Nucleotide(s) |
|---|---|
| Ub | beta-L-uridine-3'-phosphate |
| Ubs | beta-L-uridine-3'-phosphorothioate |
| Uf | 2'-fluorouridine-3'-phosphate |
| Ufs | 2'-fluorouridine-3'-phosphorothioate |
| (Uhd) | 2'-O-hexadecyl-uridine-3'-phosphate |
| (Uhds) | 2'-O-hexadecyl-uridine-3'-phosphorothioate |
| Us | uridine-3'-phosphorothioate |
| N | any nucleotide (G, A, C, T or U) |
| a | 2'-O-methyladenosine-3'-phosphate |
| as | 2'-O-methyladenosine-3'-phosphorothioate |
| c | 2'-O-methylcytidine-3'-phosphate |
| cs | 2'-O-methylcytidine-3'-phosphorothioate |
| g | 2'-O-methylguanosine-3'-phosphate |
| gs | 2'-O-methylguanosine-3'-phosphorothioate |
| t | 2'-O-methyl-5-methyluridine-3'-phosphate |
| ts | 2'-O-methyl-5-methyluridine-3'-phosphorothioate |
| u | 2'-O-methyluridine-3'-phosphate |
| us | 2'-O-methyluridine-3'-phosphorothioate |
| dA | 2'-deoxyadenosine-3'-phosphate |
| dAs | 2'-deoxyadenosine-3'-phosphorothioate |
| dC | 2'-deoxycytidine-3'-phosphate |
| dCs | 2'-deoxycytidine-3'-phosphorothioate |
| dG | 2'-deoxyguanosine-3'-phosphate |
| dGs | 2'-deoxyguanosine-3'-phosphorothioate |
| dT | 2'-deoxythymidine |
| dTs | 2'-deoxythymidine-3'-phosphorothioate |
| dU | 2'-deoxyuridine |
| s | phosphorothioate linkage |
| L96[1] | N-[tris(GalNAc-alkyl)-amidodecanoyl)]-4-hydroxyprolinol Hyp-(GalNAc-alkyl)3 |
| (Aeo) | 2'-O-methoxyethyladenosine-3'-phosphate |
| (Aeos) | 2'-O-methoxyethyladenosine-3'-phosphorothioate |
| (Geo) | 2'-O-methoxyethylguanosine-3'-phosphate |
| (Geos) | 2'-O-methoxyethylguanosine-3'-phosphorothioate |
| (Teo) | 2'-O-methoxyethyl-5-methyluridine-3'-phosphate |
| (Teos) | 2'-O-methoxyethyl-5-methyluridine-3'-phosphorothioate |
| (m5Ceo) | 2'-O-methoxyethyl-5-methylcytidine-3'-phosphate |
| (m5Ceos) | 2'-O-methoxyethyl-5-methylcytidine-3'-phosphorothioate |

[1]The chemical structure of L96 is as follows:

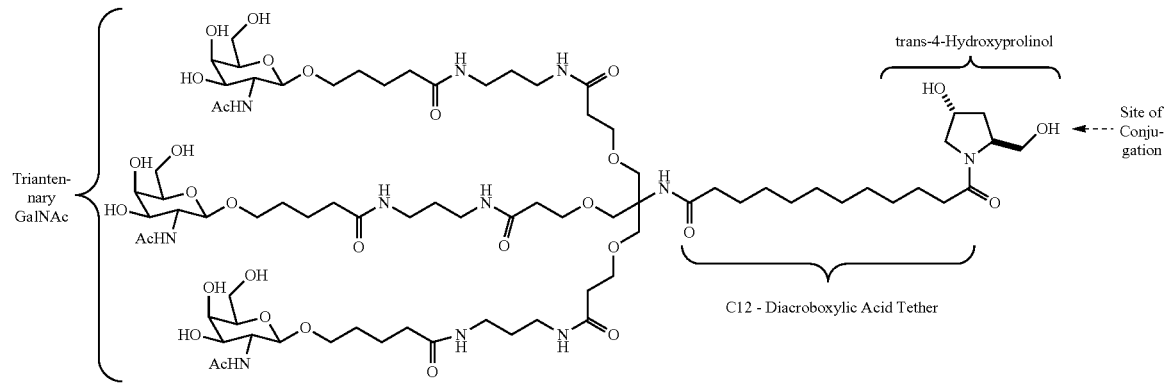

Example 2

ALAS1 siRNA Design and Synthesis

Experimental Methods
Bioinformatics
Transcripts siRNA design was carried out to identify siRNAs targeting human, rhesus (*Macaca mulatta*), mouse, and rat ALAS1 transcripts annotated in the NCBI Gene database (http://www.ncbi.nlm.nih.gov/gene/). Design used the following transcripts from the NCBI RefSeq collection: Human—NM_000688.4 (see FIG. 3), NM_199166.1; Rhesus—XM_001090440.2, XM_001090675.2; Mouse—NM_020559.2; Rat—NM_024484.2. Due to high primate/rodent sequence divergence, siRNA duplexes were designed in several separate batches, including but not limited to batches containing duplexes matching human and rhesus transcripts only; human, rhesus, mouse, and rat transcripts only; and mouse and rat transcripts only. Most siRNA duplexes were designed that shared 100% identity the listed human transcript and other species transcripts considered in each design batch (above). In some instances, (see Table 8) mismatches between duplex and mRNA target were allowed at the first antisense (last sense) position when the antisense strand:target mRNA complementary basepair was a GC or CG pair. In these cases, duplexes were designed with UA or AU pairs at the first antisense:last sense pair. Thus the duplexes maintained complementarity but were mismatched with respect to target (U:C, U:G, A:C, or A:G). Eighteen of these "UA-swap" duplexes were designed as part of the human/rhesus/mouse/rat set (see duplexes in Table 8 with "C19U", "G19U", "C19A", or "G19A" labels in the Position column)

siRNA Design, Specificity, and Efficacy Prediction

The predicted specificity of all possible 19mers was predicted from each sequence. Candidate 19mers were then selected that lacked repeats longer than 7 nucleotides. These 1510 candidate human/rhesus, 114 human/rhesus/mouse/rat, and 717 mouse/rat siRNAs were used in comprehensive searches against the appropriate transcriptomes (defined as the set of NM_and XM_records within the human, rhesus, dog, mouse, or rat NCBI Refseq sets) using an exhaustive "brute-force" algorithm implemented in the python script 'BruteForce.py'. The script next parsed the transcript-oligo alignments to generate a score based on the position and number of mismatches between the siRNA and any potential 'off-target' transcript. The off-target score is weighted to emphasize differences in the 'seed' region of siRNAs, in positions 2-9 from the 5' end of the molecule. Each oligo-transcript pair from the brute-force search was given a mismatch score by summing the individual mismatch scores; mismatches in the position 2-9 were counted as 2.8, mismatches in the cleavage site positions 10-11 were counted as 1.2, and mismatches in region 12-19 counted as 1.0. An additional off-target prediction was carried out by comparing the frequency of heptamers and octomers derived from 3 distinct, seed-derived hexamers of each oligo. The hexamers from positions 2-7 relative to the 5' start is used to create 2 heptamers and one octomer. We create 'heptamer1' by adding a 3' A to the hexamer; we create heptamer2 by adding a 5' A to the hexamer; we create the octomer by adding an A to both 5' and 3' ends of the hexamer. The frequency of octomers and heptamers in the human, rhesus, mouse, or rat 3'UTRome (defined as the subsequence of the transcriptome from NCBI's Refseq database where the end of the coding region, the 'CDS', is clearly defined) was pre-calculated. The octomer frequency was normalized to the heptamer frequency using the median value from the range of octomer frequencies. A 'mirSeedScore' was then calculated by calculating the sum of ((3×normalized octomer count)+(2×heptamer2 count)+(1×heptamer 1 count)).

Both siRNAs strands were assigned to a category of specificity according to the calculated scores: a score above 3 qualifies as highly specific, equal to 3 as specific and between 2.2 and 2.8 as moderately specific. We sorted by the specificity of the antisense strand. We then selected duplexes whose antisense oligos lacked GC at the first position, lacked G at both positions 13 and 14, and had 3 or more Us or As in the seed region (characteristics of duplexes with high predicted efficacy)

Candidate GalNac-conjugated duplexes, 21 and 23 nucleotides long on the sense and antisense strands respectively, were designed by extending antisense 19mers 4 additional nucleotides in the 3' direction (preserving perfect complementarity with the target transcript). The sense strand was specified as the reverse complement of the first 21 nucleotides of the antisense 23mer. Duplexes were selected that maintained perfect matches to all selected species transcripts across all 23 nucleotides.

siRNA Sequence Selection

A total of 90 sense and 90 antisense derived human/rhesus, 40 sense and 40 antisense derived human/rhesus/mouse/mouse/rat, and 40 sense and 40 antisense derived mouse/rat siRNA 19mer oligos were synthesized and formed into duplexes. A total of 45 sense and 45 antisense derived human/rhesus 21/23mer oligos were synthesized to yield 45 GalNac-conjugated duplexes.

The sequences of the sense and antisense strands of the modified duplexes are shown in Table 2, and the sequences of the sense and antisense strands of the unmodified duplexes are shown in Table 3.

Synthesis of ALAS1 Sequences

ALAS1 sequences were synthesized on MerMade 192 synthesizer at either 1 or 0.2 umol scale. Single strands were made with 2'O-methyl modifications for in vitro screening using transfection reagents. 3' GalNAc conjugates were made with sequences containing 2'F and 2'-O-methyl modifications on the sense strand in the 21-23 mer designs for free uptake in cells. For all the 21mer sequences in the list, 'endolight' chemistry was applied as detailed below.

- All pyrimidines (cytosine and uridine) in the sense strand contained 2'-O-Methyl bases (2' O-Methyl C and 2'-O-Methyl U)
- In the antisense strand, pyrimidines adjacent to (towards 5' position) ribo A nucleoside were replaced with their corresponding 2-O-Methyl nucleosides
- A two base dTsdT extension at 3' end of both sense and anti sense sequences was introduced
- The sequence file was converted to a text file to make it compatible for loading in the MerMade 192 synthesis software For GalNAc conjugated sense strands and complementary antisense sequences, 2'F and other modified nucleosides were introduced in combination with ribo with 2'O-Methyl nucleosides. The synthesis was performed on a GalNAc modified CPG support for the sense strand and CPG modified with universal support on the antisense sequence.

Synthesis, Cleavage and Deprotection:

The synthesis of ALAS1 sequences used solid supported oligonucleotide synthesis using phosphoramidite chemistry. For 21 mer endolight sequences, a deoxy thymidine CPG was used as the solid support while for the GalNAc conjugates, GalNAc solid support for sense strand and an universal CPG for the antisesense strand were used.

The synthesis of the above sequences was performed at either 1 or 0.2 um scale in 96 well plates. The amidite solutions were prepared at 0.1M concentration and ethyl thio tetrazole (0.6M in Acetonitrile) was used as activator.

The synthesized sequences were cleaved and deprotected in 96 well plates, using methylamine in the first step and fluoride reagent in the second step. For GalNAc and 2'F nucleoside containing sequences, deprotection conditions were modified. Sequences after cleavage and deprotection were precipitated using acetone:ethanol (80:20) mix and the pellet were re-suspended in 0.2M sodium acetate buffer. Samples from each sequence were analyzed by LC-MS to confirm the identity, UV for quantification and a selected set of samples by IEX chromatography to determine purity.

Purification and Desalting:

ALAS1 sequences were precipitated and purified on AKTA Purifier system using Sephadex column. The ALAS1ess was run at ambient temperature. Sample injection and collection was performed in 96 well (1.8 mL-deep well) plates. A single peak corresponding to the full length sequence was collected in the eluent. The desalted ALAS1 sequences were analyzed for concentration (by UV measurement at A260) and purity (by ion exchange HPLC). The complementary single strands were then combined in a 1:1 stoichiometric ratio to form siRNA duplexes.

TABLE 2

Human ALAS1 Modified Single Strands and Duplex Sequences

| SEQ ID NO: (sense) | SEQ ID NO: (anti-sense) | Position on transcript NM_000688.4 | Duplex Name | Sense Sequence (5'-3') | Antisense Sequence (5'-3') |
|---|---|---|---|---|---|
| 2 | 3 | 522-540 | AD-55078.2 | cuccGGccAGuGAGAAAGAdTsdT | UCUUUCUcACUGGCCGGAGdTsdT |
| 4 | 5 | 669-687 | AD-55084.2 | uGGcAGcAcAGAuGAAucAdTsdT | UGAUUcAUCUGUGCUGCcAdTsdT |
| 6 | 7 | 790-808 | AD-55090.2 | cAGuGuGGuuAGuGuGAAAdTsdT | UUUcAcACuAACcAcACUGdTsdT |
| 8 | 9 | 853-871 | AD-55096.2 | cAucAuGcAAAAGcAAAGAdTsdT | UCUUUGCUUUUGcAUGAUGdTsdT |
| 10 | 11 | 876-894 | AD-55102.2 | AAAGAGuGucucAucuucudTsdT | AGAAGAUGAGAcACUCUUUdTsdT |
| 12 | 13 | 877-895 | AD-55106.2 | AAGAGuGucucAucuucuudTsdT | AAGAAGAUGAGAcACUCUUdTsdT |
| 14 | 15 | 914-932 | AD-55111.2 | ucuGuuuccAcuuuucAGudTsdT | ACUGAAAAGUGGAAAcAGAdTsdT |
| 16 | 17 | 923-941 | AD-55073.2 | AcuuuucAGuAuGAucGuudTsdT | AACGAUcAUCUGAAAAGUdTsdT |
| 18 | 19 | 926-944 | AD-55079.2 | uuucAGuAuGAucGuuucudTsdT | AGAAACGAUcAuACUGAAAdTsdT |
| 20 | 21 | 927-945 | AD-55085.2 | uucAGuAuGAucGuuucuudTsdT | AAGAAACGAUcAuACUGAAdTsdT |
| 22 | 23 | 928-946 | AD-55091.2 | ucAGuAuGAucGuuucuuudTsdT | AAAGAAACGAUcAuACUGAdTsdT |
| 24 | 25 | 932-950 | AD-55097.2 | uAuGAucGuuucuuuGAGAdTsdT | UCUcAAAGAAACGAUcAuAdTsdT |
| 26 | 27 | 973-991 | AD-55103.2 | uGAccAcAccuAucGAGuudTsdT | AACUCGAuAGGUGUGGUcAdTsdT |
| 28 | 29 | 975-993 | AD-55107.2 | AccAcAccuAucGAGuuuudTsdT | AAAACUCGAuAGGUGUGGUdTsdT |
| 30 | 31 | 1029-1047 | AD-55112.2 | uGGcAGAuGAcuAuucAGAdTsdT | UCUGAAuAGUcAUCUGCcAdTsdT |
| 32 | 33 | 1077-1095 | AD-55074.2 | ucuGGuGcAGuAuGAcuAdTsdT | uAGUcAUuACUGcACcAGAdTsdT |
| 34 | 35 | 1124-1142 | AD-55080.2 | uGGGGGcAGuuAuGGAcAdTsdT | UGUCcAuAACUGCCCcAcAdTsdT |
| 36 | 37 | 1137-1155 | AD-55086.2 | uGGAcAcuuuGAAAcAAcAdTsdT | UGUUGUUUcAAAGUGUCcAdTsdT |
| 38 | 39 | 1182-1200 | AD-55098.2 | AuAuuucuGGAAcuAGuAAdTsdT | UuACuAGUUCcAGAAAuAUdTsdT |
| 40 | 41 | 1184-1202 | AD-55104.2 | AuuucuGGAAcuAGuAAAudTsdT | AUUuACuAGUUCcAGAAAUdTsdT |
| 42 | 43 | 1185-1203 | AD-55108.2 | uuucuGGAAcuAGuAAAuudTsdT | AAUUuACuAGUUCcAGAAAdTsdT |
| 44 | 45 | 1188-1206 | AD-55113.2 | cuGGAAcuAGuAAAuuccAdTsdT | UGGAAUUuACuAGUUCcAGdTsdT |
| 46 | 47 | 1325-1343 | AD-55075.2 | uGuGAGAuuuAcucuGAuudTsdT | AAUcAGAGuAAAUCUcAcAdTsdT |
| 48 | 49 | 1364-1382 | AD-55081.2 | AuccAAGGGAuucGAAAcAdTsdT | UGUUUCGAAUCCCUUGGAUdTsdT |
| 50 | 51 | 1382-1400 | AD-55087.2 | AGccGAGuGccAAAGuAcAdTsdT | UGuACUUUGGcACUCGGCUdTsdT |
| 52 | 53 | 1478-1496 | AD-55093.2 | uuuGAAAcuGuccAuucAAdTsdT | UUGAAUGGAcAGUUUcAAAdTsdT |
| 54 | 55 | 1531-1549 | AD-55099.2 | uGAuGuGGcccAuGAGuuudTsdT | AAACUcAUGGGCcAcAUcAdTsdT |
| 56 | 57 | 1631-1649 | AD-53573.3 | GucAuGccAAAAAuGGAcAdTsdT | UGUCcAUUUUGGcAUGACdTsdT |
| 58 | 59 | 1637-1655 | AD-55109.2 | ccAAAAAuGGAcAucAuuudTsdT | AAAUGAUGUCcAUUUUUGGdTsdT |
| 60 | 61 | 1706-1724 | AD-55114.2 | AcGAGuucucuGAuuGAcAdTsdT | UGUcAAUcAGAGAACUCGUdTsdT |
| 62 | 63 | 1962-1980 | AD-55076.2 | AAGucuGuGAuGAAcuAAudTsdT | AUuAGUUcAUcAcAGACUUdTsdT |
| 64 | 65 | 1967-1985 | AD-55082.2 | uGuGAuGAAcuAAuGAGcAdTsdT | UGCUcAUuAGUUcAUcAcAdTsdT |
| 66 | 67 | 1977-1995 | AD-55088.2 | uAAuGAGcAGAcAuAAcAdTsdT | AUGUuAUGUCUGCUcAUuAdTsdT |
| 68 | 69 | 2189-2207 | AD-55094.2 | uuuGAAGuGAuGAGuGAAAdTsdT | UUUcACUcAUcACUUcAAAdTsdT |
| 70 | 71 | 2227-2245 | AD-55100.2 | AGGcuuGAGcAAGuuGGudTsdT | uACcAACUUGCUcAAGCCUdTsdT |
| 72 | 73 | 2313-2331 | AD-55105.2 | ucuucAGAGuuGucuuuAudTsdT | AuAAAGAcAACUCUGAAGAdTsdT |

TABLE 2-continued

Human ALAS1 Modified Single Strands and Duplex Sequences

| SEQ ID NO: (sense) | SEQ ID NO: (anti-sense) | Position on transcript NM_000688.4 | Duplex Name | Sense Sequence (5'-3') | Antisense Sequence (5'-3') |
|---|---|---|---|---|---|
| 74 | 75 | 2317-2335 | AD-55110.2 | cAGAGuuGucuuuAuAuGudTsdT | AcAuAuAAAGAcAACUCUGdTsdT |
| 76 | 77 | 2319-2337 | AD-55115.2 | GAGuuGucuuuAuAuGuGAdTsdT | UcAcAuAuAAAGAcAACUCdTsdT |
| 78 | 79 | 2320-2338 | AD-55077.2 | AGuuGucuuuAuAuGuGAAdTsdT | UUcAcAuAuAAAGAcAACUdTsdT |
| 80 | 81 | 2344-2362 | AD-55083.2 | uuAuAuuAAAuuuuAAucudTsdT | AGAUuAAAAUUuAAuAuAAdTsdT |
| 82 | 83 | 2352-2370 | AD-55089.2 | AAuuuuAAcuAuAGuAAAdTsdT | UUuACuAuAGAUuAAAAUUdTsdT |
| 84 | 85 | 2353-2371 | AD-55095.2 | AuuuuAAcuAuAGuAAAAdTsdT | UUUuACuAuAGAUuAAAAUdTsdT |
| 86 | 87 | 2376-2394 | AD-55101.2 | AGuccuGGAAAuAAAuucudTsdT | AGAAUUuAUUUCcAGGACUdTsdT |
| 88 | 89 | 358-376 | AD-53511.1 | cuGcccAuucuuAucccGAdTsdT | UCGGGAuAAGAAUGGGcAGdTsdT |
| 90 | 91 | 789-807 | AD-53512.1 | ccAGuGuGGuuAGuGuGAAdTsdT | UUcACuAACcAcACUGGdTsdT |
| 92 | 93 | 1076-1094 | AD-53513.1 | GucuGGuGcAGuAAuGAcudTsdT | AGUcAUuACUGcACcAGACdTsdT |
| 94 | 95 | 1253-1271 | AD-53514.1 | GcAcucuuGuuuuccucGudTsdT | ACGAGGAAAAcAAGAGUGCdTsdT |
| 96 | 97 | 1544-1562 | AD-53515.1 | GAGuuuGGAGcAAucAccudTsdT | AGGUGAUUGCUCcAAACUdTsdT |
| 98 | 99 | 2228-2246 | AD-53516.1 | GGcuuGAGcAAGuuGGuAudTsdT | AuACcAACUUGCUcAAGCCdTsdT |
| 100 | 101 | 404-422 | AD-53517.1 | GGcAAAucucuGuuGuucudTsdT | AGAAcAAcAGAGAUUUGCCdTsdT |
| 102 | 103 | 404-422 | AD-53517.1 | GGcAAAucucuGuuGuucudTsdT | AGAAcAAcAGAGAUUUGCCdTsdT |
| 104 | 105 | 866-884 | AD-53518.1 | cAAAGAccAGAAAGAGuGudTsdT | AcACUCUUUCUGGUCUUUGdTsdT |
| 106 | 107 | 1080-1098 | AD-53519.1 | GGuGcAGuAAuGAcuAccudTsdT | AGGuAGUcAUuACUGcACCdTsdT |
| 108 | 109 | 1258-1276 | AD-53520.1 | cuuGuuuuccucGuGcuuudTsdT | AAAGcACGAGGAAAAcAAGdTsdT |
| 110 | 111 | 1616-1634 | AD-53521.1 | GGGGAucGGGAuGGAGucAdTsdT | UGACUCcAUCCCGAUCCCCdTsdT |
| 112 | 113 | 2230-2248 | AD-53522.1 | cuuGAGcAAGuuGGuAucudTsdT | AGAuAccAACUUGCUcAAGdTsdT |
| 114 | 115 | 436-454 | AD-53523.1 | ccccAAGAuGAuGGAAGuudTsdT | AACUUCcAUcAUCUUGGGGdTsdT |
| 116 | 117 | 436-454 | AD-53523.1 | ccccAAGAuGAuGGAAGuudTsdT | AACUUCcAUcAUCUUGGGGdTsdT |
| 118 | 119 | 885-903 | AD-53524.1 | cucAucuucuucAAGAuAAdTsdT | UuAUCUUGAAGAAGAUGAGdTsdT |
| 120 | 121 | 1127-1145 | AD-53525.1 | GGGGcAGuuAuGGAcAcuudTsdT | AAGUGUCcAUaACUGCCCCdTsdT |
| 122 | 123 | 1315-1333 | AD-53526.1 | GAuGccAGGcuGuGAGAuudTsdT | AAUCUcAcAGCCUGGcAUCdTsdT |
| 124 | 125 | 1870-1888 | AD-53527.1 | GAGAcAGAuGcuAAuGGAudTsdT | AUCcAUuAGcAUCUGUCUCdTsdT |
| 126 | 127 | 2286-2304 | AD-53528.1 | ccccAGGccAuuAucAuAudTsdT | AuAUGAuAAUGGCCUGGGGdTsdT |
| 128 | 129 | 489-507 | AD-53529.1 | cAGcAGuAcAcuAccAAcAdTsdT | UGUUGGuAGUGuACUGCUGdTsdT |
| 130 | 131 | 489-507 | AD-53529.1 | cAGcAGuAcAcuAccAAcAdTsdT | UGUUGGuAGUGuACUGCUGdTsdT |
| 132 | 133 | 915-933 | AD-53530.1 | cuGuuuccAcuuuucAGuAdTsdT | uACUGAAAAGUGGAAAcAGdTsdT |
| 134 | 135 | 1138-1156 | AD-53531.1 | GGAcAcuuuGAAAcAAcAudTsdT | AUGUUGUUUcAAAGUGUCCdTsdT |
| 136 | 137 | 1324-1342 | AD-53532.1 | cuGuGAGAuuuAcucuGAudTsdT | AUcAGAGuAAAUCUcAcAGdTsdT |
| 138 | 139 | 1927-1945 | AD-53533.1 | cccuGuGcGGGuuGcAGAudTsdT | AUCUGcAACCCGcAcAGGGdTsdT |
| 140 | 141 | 2312-2330 | AD-53534.1 | GucuucAGAGuuGucuuuAdTsdT | uAAAGAcAACUCUGAAGACdTsdT |
| 142 | 143 | 646-664 | AD-53535.1 | cAcuGcAAGcAAAuGcccudTsdT | AGGGcAUUUGCUUGcAGUGdTsdT |
| 144 | 145 | 922-940 | AD-53536.1 | cAcuuuucAGuAuGAucGudTsdT | ACGAUcAuACUGAAAAGUGdTsdT |

TABLE 2-continued

Human ALAS1 Modified Single Strands and Duplex Sequences

| SEQ ID NO: (sense) | SEQ ID NO: (anti-sense) | Position on transcript NM_000688.4 | Duplex Name | Sense Sequence (5'-3') | Antisense Sequence (5'-3') |
|---|---|---|---|---|---|
| 146 | 147 | 1163-1181 | AD-53537.1 | GGGGcAGGuGGuAcuAGAAdTsdT | UUCuAGuACcACCUGCCCCdTsdT |
| 148 | 149 | 1347-1365 | AD-53538.1 | GGAAccAuGccuccAuGAudTsdT | AUcAUGGAGGcAUGGUUCCdTsdT |
| 150 | 151 | 1964-1982 | AD-53539.1 | GucuGuGAuGAAcuAAuGAdTsdT | UcAUuAGUUcAUcAcAGACdTsdT |
| 152 | 153 | 2321-2339 | AD-53540.1 | GuuGucuuuAuAuGuGAAudTsdT | AUUcAcAuAuAAAGAcAACdTsdT |
| 154 | 155 | 671-689 | AD-53541.1 | GcAGcAcAGAuGAAucAGAdTsdT | UCUGAUUcAUCUGUGCUGCdTsdT |
| 156 | 157 | 924-942 | AD-53542.1 | cuuuucAGuAuGAucGuuudTsdT | AAACGAUcAuACUGAAAAGdTsdT |
| 158 | 159 | 1164-1182 | AD-53543.1 | GGGcAGGuGGuAcuAGAAAdTsdT | UUUCuAGuACcACCUGCCCdTsdT |
| 160 | 161 | 1460-1478 | AD-53544.1 | GuccccAAGAuuGuGGcAudTsdT | AUGCcAcAAUCUUGGGGAcdTsdT |
| 162 | 163 | 1976-1994 | AD-53545.1 | cuAAuGAGcAGAcAuAAcAdTsdT | UGUuAUGUCUGCUcAUuAGdTsdT |
| 164 | 165 | 786-804 | AD-53546.1 | GccccAGuGuGGuuAGuGudTsdT | AcAcUAACcAcACUGGGGCdTsdT |
| 166 | 167 | 935-953 | AD-53547.1 | GAucGuuucuuuGAGAAAAdTsdT | UUUUCUcAAAGAAACGAUCdTsdT |
| 168 | 169 | 1165-1183 | AD-53548.1 | GGcAGGuGGuAcuAGAAAdTsdT | AUUUCuAGuACcACCUGCCCdTsdT |
| 170 | 171 | 1530-1548 | AD-53549.1 | GuGAuGuGGcccAuGAGuudTsdT | AACUcAUGGGCcAcAUcACdTsdT |
| 172 | 173 | 2003-2021 | AD-53550.1 | cAAGcAAucAAuuAcccuAdTsdT | uAGGGuAAUUGAUUGCUUGdTsdT |
| 174 | 175 | 788-806 | AD-53551.1 | cccAGuGuGGuuAGuGuAdTsdT | UcAcACuAACcAcACUGGGdTsdT |
| 176 | 177 | 974-992 | AD-53552.1 | GAccAcAccuAucGAGuuudTsdT | AAACUCGAuAGGUGUGGUCdTsdT |
| 178 | 179 | 1191-1209 | AD-53553.1 | GAAcuAGuAAAuuccAuGudTsdT | AcAUGGAAUUuACuAGUUCdTsdT |
| 180 | 181 | 1541-1559 | AD-53554.1 | cAuGAGuuuGGAGcAAucAdTsdT | UGAUUGCUCcAAACUcAUGdTsdT |
| 182 | 183 | 2075-2093 | AD-53555.1 | ccccAGAuGAuGAAcuAcAdTsdT | AGuAGUUcAUcAUCUGGGGdTsdT |
| 184 | 185 | 360-378 | AD-53561.1 | GcccAuucuuAucccGAGudTsdT | ACUCGGGAuAAGAAUGGGCdTsdT |
| 186 | 187 | 1356-1374 | AD-53567.1 | ccuccAuGAuccAAGGGAudTsdT | AUCCCUUGGAUcAUGGAGGdTsdT |
| 188 | 189 | 1631-1649 | AD-53573.1 | GucAuGccAAAAAuGGAcAdTsdT | UGUCcAUUUUUGGcAUGACdTsdT |
| 190 | 191 | 1634-1652 | AD-53579.1 | AuGccAAAAAuGGAcAucAdTsdT | UGAUGUCcAUUUUUGGcAUdTsdT |

TABLE 3

Human ALAS1 Unmodified Single Strands and Duplex Sequences

| SEQ ID NO: (sense) | SEQ ID NO: (anti-sense) | Position on transcript NM_000688.4 | Duplex Name | Sense Sequence (5'-3') | Antisense Sequence (5'-3') |
|---|---|---|---|---|---|
| 192 | 193 | 522-540 | AD-55078.2 | CUCCGGCCAGUGAGAAAGA | UCUUUCUCACUGGCCGGAG |
| 194 | 195 | 669-687 | AD-55084.2 | UGGCAGCACAGAUGAAUCA | UGAUUCAUCUGUGCUGCCA |
| 196 | 197 | 790-808 | AD-55090.2 | CAGUGUGGUUAGUGUGAAA | UUUCACACUAACCACACUG |
| 198 | 199 | 853-871 | AD-55096.2 | CAUCAUGCAAAAGCAAAGA | UCUUUGCUUUUGCAUGAUG |
| 200 | 201 | 876-894 | AD-55102.2 | AAAGAGUGUCUCAUCUUCU | AGAAGAUGAGACACUCUUU |
| 202 | 203 | 877-895 | AD-55106.2 | AAGAGUGUCUCAUCUUCUU | AAGAAGAUGAGACACUCUU |
| 204 | 205 | 914-932 | AD-55111.2 | UCUGUUUCCACUUUUCAGU | ACUGAAAAGUGGAAACAGA |

TABLE 3-continued

Human ALAS1 Unmodified Single Strands and Duplex Sequences

| SEQ ID NO: (sense) | SEQ ID NO: (anti-sense) | Position on transcript NM_000688.4 | Duplex Name | Sense Sequence (5'-3') | Antisense Sequence (5'-3') |
|---|---|---|---|---|---|
| 206 | 207 | 923-941 | AD-55073.2 | ACUUUUCAGUAUGAUCGUU | AACGAUCAUACUGAAAAGU |
| 208 | 209 | 926-944 | AD-55079.2 | UUUCAGUAUGAUCGUUUCU | AGAAACGAUCAUACUGAAA |
| 210 | 211 | 927-945 | AD-55085.2 | UUCAGUAUGAUCGUUUCUU | AAGAAACGAUCAUACUGAA |
| 212 | 213 | 928-946 | AD-55091.2 | UCAGUAUGAUCGUUUCUUU | AAAGAAACGAUCAUACUGA |
| 214 | 215 | 932-950 | AD-55097.2 | UAUGAUCGUUUCUUUGAGA | UCUCAAAGAAACGAUCAUA |
| 216 | 217 | 973-991 | AD-55103.2 | UGACCACACCUAUCGAGUU | AACUCGAUAGGUGUGGUCA |
| 218 | 219 | 975-993 | AD-55107.2 | ACCACACCUAUCGAGUUUU | AAAACUCGAUAGGUGUGGU |
| 220 | 221 | 1029-1047 | AD-55112.2 | UGGCAGAUGACUAUUCAGA | UCUGAAUAGUCAUCUGCCA |
| 222 | 223 | 1077-1095 | AD-55074.2 | UCUGGUGCAGUAAUGACUA | UAGUCAUUACUGCACCAGA |
| 224 | 225 | 1124-1142 | AD-55080.2 | UGUGGGGCAGUUAUGGACA | UGUCCAUAACUGCCCCACA |
| 226 | 227 | 1137-1155 | AD-55086.2 | UGGACACUUUGAAACAACA | UGUUGUUUCAAAGUGUCCA |
| 228 | 229 | 1182-1200 | AD-55098.2 | AUAUUUCUGGAACUAGUAA | UUACUAGUUCCAGAAAUAU |
| 230 | 231 | 1184-1202 | AD-55104.2 | AUUUCUGGAACUAGUAAAU | AUUUACUAGUUCCAGAAAU |
| 232 | 233 | 1185-1203 | AD-55108.2 | UUUCUGGAACUAGUAAAUU | AAUUUACUAGUUCCAGAAA |
| 234 | 235 | 1188-1206 | AD-55113.2 | CUGGAACUAGUAAAUUCCA | UGGAAUUUACUAGUUCCAG |
| 236 | 237 | 1325-1343 | AD-55075.2 | UGUGAGAUUUACUCUGAUU | AAUCAGAGUAAAUCUCACA |
| 238 | 239 | 1364-1382 | AD-55081.2 | AUCCAAGGGAUUCGAAACA | UGUUUCGAAUCCCUUGGAU |
| 240 | 241 | 1382-1400 | AD-55087.2 | AGCCGAGUGCCAAAGUACA | UGUACUUUGGCACUCGGCU |
| 242 | 243 | 1478-1496 | AD-55093.2 | UUUGAAACUGUCCAUUCAA | UUGAAUGGACAGUUUCAAA |
| 244 | 245 | 1531-1549 | AD-55099.2 | UGAUGUGGCCCAUGAGUUU | AAACUCAUGGGCCACAUCA |
| 246 | 247 | 1631-1649 | AD-53573.3 | GUCAUGCCAAAAAUGGACA | UGUCCAUUUUUGGCAUGAC |
| 248 | 249 | 1637-1655 | AD-55109.2 | CCAAAAAUGGACAUCAUUU | AAAUGAUGUCCAUUUUUGG |
| 250 | 251 | 1706-1724 | AD-55114.2 | ACGAGUUCUCUGAUUGACA | UGUCAAUCAGAGAACUCGU |
| 252 | 253 | 1962-1980 | AD-55076.2 | AAGUCUGUGAUGAACUAAU | AUUAGUUCAUCACAGACUU |
| 254 | 255 | 1967-1985 | AD-55082.2 | UGUGAUGAACUAAUGAGCA | UGCUCAUUAGUUCAUCACA |
| 256 | 257 | 1977-1995 | AD-55088.2 | UAAUGAGCAGACAUAACAU | AUGUUAUGUCUGCUCAUUA |
| 258 | 259 | 2189-2207 | AD-55094.2 | UUUGAAGUGAUGAGUGAAA | UUUCACUCAUCACUUCAAA |
| 260 | 261 | 2227-2245 | AD-55100.2 | AGGCUUGAGCAAGUUGGUA | UACCAACUUGCUCAAGCCU |
| 262 | 263 | 2313-2331 | AD-55105.2 | UCUUCAGAGUUGUCUUUAU | AUAAAGACAACUCUGAAGA |
| 264 | 265 | 2317-2335 | AD-55110.2 | CAGAGUUGUCUUUAUAUGU | ACAUAUAAAGACAACUCUG |
| 266 | 267 | 2319-2337 | AD-55115.2 | GAGUUGUCUUUAUAUGUGA | UCACAUAUAAAGACAACUC |
| 268 | 269 | 2320-2338 | AD-55077.2 | AGUUGUCUUUAUAUGUGAA | UUCACAUAUAAAGACAACU |
| 270 | 271 | 2344-2362 | AD-55083.2 | UUAUAUUAAAUUUUAAUCU | AGAUUAAAAUUUAAUAUAA |
| 272 | 273 | 2352-2370 | AD-55089.2 | AAUUUUAAUCUAUAGUAAA | UUUACUAUAGAUUAAAAUU |
| 274 | 275 | 2353-2371 | AD-55095.2 | AUUUUAAUCUAUAGUAAAU | UUUACUAUAGAUUAAAAUU |
| 276 | 277 | 2376-2394 | AD-55101.2 | AGUCCUGGAAAUAAAUUCU | AGAAUUUAUUUCCAGGACU |

TABLE 3-continued

Human ALAS1 Unmodified Single Strands and Duplex Sequences

| SEQ ID NO: (sense) | SEQ ID NO: (anti-sense) | Position on transcript NM_000688.4 | Duplex Name | Sense Sequence (5'-3') | Antisense Sequence (5'-3') |
|---|---|---|---|---|---|
| 278 | 279 | 358-376 | AD-53511.1 | CUGCCCAUUCUUAUCCCGA | UCGGGAUAAGAAUGGGCAG |
| 280 | 281 | 789-807 | AD-53512.1 | CCAGUGUGGUUAGUGUGAA | UUCACACUAACCACACUGG |
| 282 | 283 | 1076-1094 | AD-53513.1 | GUCUGGUGCAGUAAUGACU | AGUCAUUACUGCACCAGAC |
| 284 | 285 | 1253-1271 | AD-53514.1 | GCACUCUUGUUUUCCUCGU | ACGAGGAAAACAAGAGUGC |
| 286 | 287 | 1544-1562 | AD-53515.1 | GAGUUUGGAGCAAUCACCU | AGGUGAUUGCUCCAAACUC |
| 288 | 289 | 2228-2246 | AD-53516.1 | GGCUUGAGCAAGUUGGUAU | AUACCAACUUGCUCAAGCC |
| 290 | 291 | 404-422 | AD-53517.1 | GGCAAAUCUCUGUUGUUCU | AGAACAACAGAGAUUUGCC |
| 292 | 293 | 404-422 | AD-53517.1 | GGCAAAUCUCUGUUGUUCU | AGAACAACAGAGAUUUGCC |
| 294 | 295 | 866-884 | AD-53518.1 | CAAAGACCAGAAAGAGUGU | ACACUCUUUCUGGUCUUUG |
| 296 | 297 | 1080-1098 | AD-53519.1 | GGUGCAGUAAUGACUACCU | AGGUAGUCAUUACUGCACC |
| 298 | 299 | 1258-1276 | AD-53520.1 | CUUGUUUUCCUCGUGCUUU | AAAGCACGAGGAAAACAAG |
| 300 | 301 | 1616-1634 | AD-53521.1 | GGGGAUCGGGAUGGAGUCA | UGACUCCAUCCCGAUCCCC |
| 302 | 303 | 2230-2248 | AD-53522.1 | CUUGAGCAAGUUGGUAUCU | AGAUACCAACUUGCUCAAG |
| 304 | 305 | 436-454 | AD-53523.1 | CCCCAAGAUGAUGGAAGUU | AACUUCCAUCAUCUUGGGG |
| 306 | 307 | 436-454 | AD-53523.1 | CCCCAAGAUGAUGGAAGUU | AACUUCCAUCAUCUUGGGG |
| 308 | 309 | 885-903 | AD-53524.1 | CUCAUCUUCUUCAAGAUAA | UUAUCUUGAAGAAGAUGAG |
| 310 | 311 | 1127-1145 | AD-53525.1 | GGGGCAGUUAUGGACACUU | AAGUGUCCAUAACUGCCCC |
| 312 | 313 | 1315-1333 | AD-53526.1 | GAUGCCAGGCUGUGAGAUU | AAUCUCACAGCCUGGCAUC |
| 314 | 315 | 1870-1888 | AD-53527.1 | GAGACAGAUGCUAAUGGAU | AUCCAUUAGCAUCUGUCUC |
| 316 | 317 | 2286-2304 | AD-53528.1 | CCCCAGGCCAUUAUCAUAU | AUAUGAUAAUGGCCUGGGG |
| 318 | 319 | 489-507 | AD-53529.1 | CAGCAGUACACUACCAACA | UGUUGGUAGUGUACUGCUG |
| 320 | 321 | 489-507 | AD-53529.1 | CAGCAGUACACUACCAACA | UGUUGGUAGUGUACUGCUG |
| 322 | 323 | 915-933 | AD-53530.1 | CUGUUUCCACUUUUCAGUA | UACUGAAAAGUGGAAACAG |
| 324 | 325 | 1138-1156 | AD-53531.1 | GGACACUUUGAAACAACAU | AUGUUGUUUCAAAGUGUCC |
| 326 | 327 | 1324-1342 | AD-53532.1 | CUGUGAGAUUUACUCUGAU | AUCAGAGUAAAUCUCACAG |
| 328 | 329 | 1927-1945 | AD-53533.1 | CCCUGUGCGGGUUGCAGAU | AUCUGCAACCCGCACAGGG |
| 330 | 331 | 2312-2330 | AD-53534.1 | GUCUUCAGAGUUGUCUUUA | UAAAGACAACUCUGAAGAC |
| 332 | 333 | 646-664 | AD-53535.1 | CACUGCAAGCAAAUGCCCU | AGGGCAUUUGCUUGCAGUG |
| 334 | 335 | 922-940 | AD-53536.1 | CACUUUUCAGUAUGAUCGU | ACGAUCAUACUGAAAAGUG |
| 336 | 337 | 1163-1181 | AD-53537.1 | GGGGCAGGUGGUACUAGAA | UUCUAGUACCACCUGCCCC |
| 338 | 339 | 1347-1365 | AD-53538.1 | GGAACCAUGCCUCCAUGAU | AUCAUGGAGGCAUGGUUCC |
| 340 | 341 | 1964-1982 | AD-53539.1 | GUCUGUGAUGAACUAAUGA | UCAUUAGUUCAUCACAGAC |
| 342 | 343 | 2321-2339 | AD-53540.1 | GUUGUCUUUAUAUGUGAAU | AUUCACAUAUAAAGACAAC |
| 344 | 345 | 671-689 | AD-53541.1 | GCAGCACAGAUGAAUCAGA | UCUGAUUCAUCUGUGCUGC |
| 346 | 347 | 924-942 | AD-53542.1 | CUUUUCAGUAUGAUCGUUU | AAACGAUCAUACUGAAAAG |
| 348 | 349 | 1164-1182 | AD-53543.1 | GGGCAGGUGGUACUAGAAA | UUUCUAGUACCACCUGCCC |

TABLE 3-continued

Human ALAS1 Unmodified Single Strands and Duplex Sequences

| SEQ ID NO: (sense) | SEQ ID NO: (anti-sense) | Position on transcript NM_000688.4 | Duplex Name | Sense Sequence (5'-3') | Antisense Sequence (5'-3') |
|---|---|---|---|---|---|
| 350 | 351 | 1460-1478 | AD-53544.1 | GUCCCCAAGAUUGUGGCAU | AUGCCACAAUCUUGGGGAC |
| 352 | 353 | 1976-1994 | AD-53545.1 | CUAAUGAGCAGACAUAACA | UGUUAUGUCUGCUCAUUAG |
| 354 | 355 | 786-804 | AD-53546.1 | GCCCCAGUGUGGUUAGUGU | ACACUAACCACACUGGGGC |
| 356 | 357 | 935-953 | AD-53547.1 | GAUCGUUUCUUUGAGAAAA | UUUUCUCAAAGAAACGAUC |
| 358 | 359 | 1165-1183 | AD-53548.1 | GGCAGGUGGUACUAGAAAU | AUUUCUAGUACCACCUGCC |
| 360 | 361 | 1530-1548 | AD-53549.1 | GUGAUGUGGCCCAUGAGUU | AACUCAUGGGCCACAUCAC |
| 362 | 363 | 2003-2021 | AD-53550.1 | CAAGCAAUCAAUUACCCUA | UAGGGUAAUUGAUUGCUUG |
| 364 | 365 | 788-806 | AD-53551.1 | CCCAGUGUGGUUAGUGUGA | UCACACUAACCACACUGGG |
| 366 | 367 | 974-992 | AD-53552.1 | GACCACACCUAUCGAGUUU | AAACUCGAUAGGUGUGGUC |
| 368 | 369 | 1191-1209 | AD-53553.1 | GAACUAGUAAAUUCCAUGU | ACAUGGAAUUUACUAGUUC |
| 370 | 371 | 1541-1559 | AD-53554.1 | CAUGAGUUUGGAGCAAUCA | UGAUUGCUCCAAACUCAUG |
| 372 | 373 | 2075-2093 | AD-53555.1 | CCCCAGAUGAUGAACUACU | AGUAGUUCAUCAUCUGGGG |
| 374 | 375 | 360-378 | AD-53561.1 | GCCCAUUCUUAUCCCGAGU | ACUCGGGAUAAGAAUGGGC |
| 376 | 377 | 1356-1374 | AD-53567.1 | CCUCCAUGAUCCAAGGGAU | AUCCCUUGGAUCAUGGAGG |
| 378 | 379 | 1631-1649 | AD-53573.1 | GUCAUGCCAAAAAUGGACA | UGUCCAUUUUUGGCAUGAC |
| 380 | 381 | 1634-1652 | AD-53579.1 | AUGCCAAAAAUGGACAUCA | UGAUGUCCAUUUUUGGCAU |

Example 3

In Vitro Screening of ALAS1 siRNA Duplexes for ALAS1 Knockdown Activity

ALAS1 siRNA duplexes were screened for the ability to knockdown ALAS1 expression in vitro.

In Vitro Screening

Cell Culture and Transfections

Hep3B cells (ATCC, Manassas, Va.) were grown to near confluence at 37° C. in an atmosphere of 5% $CO_2$ in MEM (ATCC) supplemented with 10% FBS, before being released from the plate by trypsinization. Transfection was carried out by adding 14.8 μl of Opti-MEM plus 0.2 μl of Lipofectamine RNAiMax per well (Invitrogen, Carlsbad Calif. cat #13778-150) to 5 μl of siRNA duplexes per well into a 96-well plate and incubated at room temperature for 15 minutes. 80 μl of complete growth media containing ~$2\times10^4$ Hep3B cells were then added to the siRNA mixture. Cells were incubated for either 24 or 120 hours prior to RNA purification. Single dose experiments were performed at 10 nM and 0.1 nM final duplex concentration and dose response experiments were done at 10, 1.67, 0.27, 0.046, 0.0077, 0.0013, 0.00021, 0.00004 nM final duplex concentration.

Total RNA Isolation Using DYNABEADS mRNA Isolation Kit (Invitrogen, Part #: 610-12)

Cells were harvested and lysed in 150 μl of Lysis/Binding Buffer then mixed for 5 minutes at 850 rpm using an Eppendorf Thermomixer (the mixing speed was the same throughout the process). Ten microliters of magnetic beads and 80 μl Lysis/Binding Buffer mixture were added to a round bottom plate and mixed for 1 minute. Magnetic beads were captured using magnetic stand and the supernatant was removed without disturbing the beads. After removing supernatant, the lysed cells were added to the remaining beads and mixed for 5 minutes. After removing supernatant, magnetic beads were washed 2 times with 150 μl Wash Buffer A and mixed for 1 minute. Beads were captured again and supernatant removed. Beads were then washed with 150 μl Wash Buffer B, captured and supernatant was removed. Beads were next washed with 150 μl Elution Buffer, captured and supernatant removed. Beads were allowed to dry for 2 minutes. After drying, 50 μl of Elution Buffer was added and mixed for 5 minutes at 70° C. Beads were captured on magnet for 5 minutes. 40 μl of supernatant was removed and added to another 96 well plate.

cDNA Synthesis Using ABI High Capacity cDNA Reverse Transcription Kit (Applied Biosystems, Foster City, Calif., Cat #4368813)

A master mix of 2 μl 10× Buffer, 0.8 μl 25× dNTPs, 2 μl Random primers, 1 μl Reverse Transcriptase, 1 μl RNase inhibitor and 3.2 μl of $H_2O$ per reaction were added into 10 μl total RNA. cDNA was generated using a Bio-Rad C-1000 or S-1000 thermal cycler (Hercules, Calif.) through the following steps: 25° C. 10 min, 37° C. 120 min, 85° C. 5 sec, 4° C. hold.

Real Time PCR

2 μl of cDNA were added to a master mix containing 0.5 μl GAPDH TaqMan Probe (Applied Biosystems Cat #4326317E), 0.5 μl ALAS1 TaqMan probe (Applied Biosystems cat # Hs00167441_m1) and 5 μl Lightcycler 480 probe master mix (Roche Cat #04887301001) per well in a 384 well plates (Roche cat #04887301001). Real time PCR was done in a Roche LC480 Real Time PCR system (Roche) using the ΔΔCt(RQ) assay. Each duplex was tested in two independent transfections with two biological replicates each, and each transfection was assayed in duplicate, unless otherwise noted in the summary tables.

To calculate relative fold change, real time data were analyzed using the ΔΔCt method and normalized to assays performed with cells transfected with 10 nM AD-1955, or mock transfected cells. IC50s were calculated using a 4 parameter fit model using XLFit and normalized to cells transfected with AD-1955 or naïve cells over the same dose range, or to its own lowest dose.

In Vitro Knockdown of Endogenous ALAS1 Expression by ALAS1 siRNA Duplexes

Table 4 illustrates the knockdown of ALAS1 in Hep3B cells by ALAS1 modified siRNA duplexes (See Table 2). Silencing is expressed as the fraction RNA message remaining relative to the negative (luciferase) control siRNA AD-1955. Data were generated as described above following transfection of 10 nM or 0.1 nM of each siRNA. qPCR was run using the ALAS1 TaqMan probe Hs00167441_m1.

TABLE 4

ALAS1 expression in Hep3B cells following transfection with ALAS1 siRNA

| Duplex ID | 10 nM Avg | 0.1 nM Avg | 10 nM STDEV | 0.1 nM STDEV |
|---|---|---|---|---|
| AD-55078.2 | 0.7 | 0.87 | 0.001 | 0.089 |
| AD-55084.2 | 0.08 | 0.3 | 0 | 0.04 |
| AD-55090.2 | 0.06 | 0.08 | 0.002 | 0.003 |
| AD-55096.2 | 0.61 | 0.92 | 0.171 | 0.34 |
| AD-55102.2 | 0.63 | 0.62 | 0.005 | 0.069 |
| AD-55106.2 | 0.07 | 0.08 | 0.004 | 0.027 |
| AD-55111.2 | 0.06 | 0.23 | 0.013 | 0.062 |
| AD-55073.2 | 0.21 | 0.4 | 0.018 | 0.061 |
| AD-55079.2 | 0.17 | 0.43 | 0.033 | 0.089 |
| AD-55085.2 | 0.13 | 0.21 | 0.011 | 0.019 |
| AD-55091.2 | 0.27 | 0.55 | 0.033 | 0.009 |
| AD-55097.2 | 0.31 | 0.38 | 0.051 | 0.059 |
| AD-55103.2 | 0.05 | 0.11 | 0.017 | 0.006 |
| AD-55107.2 | 0.12 | 0.24 | 0.007 | 0.008 |
| AD-55112.2 | 0.15 | 0.2 | 0.036 | 0.025 |
| AD-55074.2 | 0.16 | 0.45 | 0.008 | 0.002 |
| AD-55080.2 | 0.79 | 0.99 | 0.095 | 0.304 |
| AD-55086.2 | 0.09 | 0.22 | 0.005 | 0.035 |
| AD-55098.2 | 0.25 | 0.51 | 0.03 | 0.07 |
| AD-55104.2 | 0.06 | 0.1 | 0.017 | 0.001 |
| AD-55108.2 | 0.47 | 0.65 | 0.03 | 0.015 |
| AD-55113.2 | 0.38 | 0.62 | 0.068 | 0.039 |
| AD-55075.2 | 0.12 | 0.28 | 0.007 | 0.051 |
| AD-55081.2 | 0.21 | 0.51 | 0.036 | 0.066 |
| AD-55087.2 | 0.1 | 0.19 | 0.017 | 0.02 |
| AD-55093.2 | 0.24 | 0.56 | 0.029 | 0.053 |
| AD-55099.2 | 0.05 | 0.18 | 0.001 | 0.038 |
| AD-53573.3 | 0.67 | 1.07 | 0.16 | 0.153 |
| AD-55109.2 | 0.07 | 0.23 | 0.006 | 0.052 |
| AD-55114.2 | 0.08 | 0.16 | 0.004 | 0.017 |
| AD-55076.2 | 0.05 | 0.14 | 0.007 | 0.035 |
| AD-55082.2 | 0.08 | 0.3 | 0.019 | 0.016 |
| AD-55088.2 | 0.06 | 0.12 | 0.008 | 0.02 |
| AD-55094.2 | 0.06 | 0.18 | 0.005 | 0.023 |
| AD-55100.2 | 0.45 | 0.83 | 0.02 | 0.05 |
| AD-55105.2 | 0.02 | 0.05 | 0.005 | 0.004 |
| AD-55110.2 | 0.15 | 0.19 | 0.031 | 0.016 |
| AD-55115.2 | 0.35 | 0.58 | 0.045 | 0.052 |
| AD-55077.2 | 0.14 | 0.14 | 0.006 | 0.019 |
| AD-55083.2 | 0.56 | 0.98 | 0.24 | 0.188 |
| AD-55089.2 | 0.62 | 0.79 | 0.036 | 0.094 |
| AD-55095.2 | 0.59 | 0.92 | 0.12 | 0.079 |
| AD-55101.2 | 0.71 | 0.97 | 0.074 | 0.097 |

TABLE 4-continued

ALAS1 expression in Hep3B cells following transfection with ALAS1 siRNA

| Duplex ID | 10 nM Avg | 0.1 nM Avg | 10 nM STDEV | 0.1 nM STDEV |
|---|---|---|---|---|
| AD-1955 | 1.00 | 1.01 | 0.03 | 0.04 |
| AD-53511.1 | 0.84 | 1.08 | 0.028 | 0.0515 |
| AD-53512.1 | 0.15 | 0.65 | 0.062 | 0.023 |
| AD-53513.1 | 0.34 | 0.86 | 0.055 | 0.011 |
| AD-53514.1 | 0.12 | 0.61 | 0.003 | 0.008 |
| AD-53515.1 | 0.25 | 0.66 | 0.005 | 0.004 |
| AD-53516.1 | 1.05 | 1.02 | 0.032 | 0.011 |
| AD-53517.1 | 0.145 | 0.725 | 0.025 | 0.0155 |
| AD-53518.1 | 0.72 | 0.85 | 0.045 | 0.028 |
| AD-53519.1 | 0.18 | 0.66 | 0.061 | 0.004 |
| AD-53520.1 | 0.18 | 0.9 | 0.041 | 0.001 |
| AD-53521.1 | 0.97 | 1.07 | 0.01 | 0.003 |
| AD-53522.1 | 0.87 | 1.1 | 0.065 | 0.112 |
| AD-53523.1 | 0.48 | 0.96 | 0.0305 | 0.0255 |
| AD-53524.1 | 0.11 | 0.66 | 0.02 | 0.006 |
| AD-53525.1 | 0.71 | 1.03 | 0.016 | 0.01 |
| AD-53526.1 | 0.23 | 0.85 | 0.075 | 0.01 |
| AD-53527.1 | 0.25 | 0.83 | 0.015 | 0.017 |
| AD-53528.1 | 0.44 | 0.93 | 0.037 | 0.006 |
| AD-53529.1 | 0.185 | 0.73 | 0.015 | 0.014 |
| AD-53530.1 | 0.1 | 0.62 | 0.02 | 0.003 |
| AD-53531.1 | 0.48 | 0.93 | 0.019 | 0.045 |
| AD-53532.1 | 0.06 | 0.17 | 0 | 0.003 |
| AD-53533.1 | 0.36 | 0.93 | 0.025 | 0.034 |
| AD-53534.1 | 0.1 | 0.36 | 0.014 | 0.012 |
| AD-53535.1 | 0.58 | 1.05 | 0.036 | 0.071 |
| AD-53536.1 | 0.12 | 0.45 | 0.009 | 0.026 |
| AD-53537.1 | 0.73 | 0.96 | 0.101 | 0.015 |
| AD-53538.1 | 0.74 | 1.07 | 0 | 0.046 |
| AD-53539.1 | 0.52 | 0.97 | 0.057 | 0.032 |
| AD-53540.1 | 0.1 | 0.47 | 0.017 | 0.012 |
| AD-53541.1 | 0.11 | 0.29 | 0.026 | 0.015 |
| AD-53542.1 | 0.08 | 0.23 | 0.008 | 0.006 |
| AD-53543.1 | 0.62 | 1.01 | 0.027 | 0.014 |
| AD-53544.1 | 0.8 | 1.04 | 0.002 | 0.001 |
| AD-53545.1 | 0.17 | 0.73 | 0.007 | 0.007 |
| AD-53546.1 | 0.27 | 0.93 | 0.058 | 0.019 |
| AD-53547.1 | 0.12 | 0.28 | 0.008 | 0.01 |
| AD-53548.1 | 0.1 | 0.34 | 0.022 | 0.002 |
| AD-53549.1 | 0.8 | 1.04 | 0.011 | 0.026 |
| AD-53550.1 | 0.05 | 0.54 | 0.02 | 0.003 |
| AD-53551.1 | 0.96 | 1.16 | 0.029 | 0.044 |
| AD-53552.1 | 0.13 | 0.5 | 0.002 | 0.009 |
| AD-53553.1 | 0.92 | 1.1 | 0.027 | 0.02 |
| AD-53554.1 | 0.76 | 0.67 | 0.005 | 0.004 |
| AD-53555.1 | 0.11 | 0.53 | 0.009 | 0.007 |
| AD-53561.1 | 0.72 | 0.94 | 0.014 | 0.001 |
| AD-53567.1 | 0.16 | 0.66 | 0.019 | 0.003 |
| AD-53573.1 | 1.06 | 1.10 | 0.019 | 0.037 |
| AD-53579.1 | 0.19 | 0.76 | 0.036 | 0.019 |

$IC_{50}$s of Select ALAS1 siRNA Duplexes in In Vitro Screen

Table 5 illustrates the $IC_{50}$s of select ALAS1 siRNA duplexes determined from the knockdown of endogenously expressed ALAS1 in the Hep3B cell line, by ALAS1 modified siRNA duplexes (see Table 2). Data were generated as described above, at 24 or 120 hours following transfection of each siRNA duplex. Silencing of ALAS1 is expressed as the fraction mRNA message remaining relative to the siRNA AD-1955, a non-targeting siRNA that was used as a negative control. Data from replicate transfection experiments were used to fit a single line to determine the $IC_{50}$. Several of the duplexes (e.g., AD-53541.1, AD-53542.1, and AD-53547.1) had an $IC_{50}$ as low as about 0.03 nM at 24 hours. Numerous duplexes had an $IC_{50}$ of less than 0.1 nM (e.g., AD-53534.1, AD-53536.1, AD-53540.1, AD-53541.1, AD-53542.1, AD-53547.1, AD-53548.1, AD-53550.1, AD-53552.1) at 24 hours, and some of these also had an $IC_{50}$ of less than 0.1 nM (e.g., AD-53534.1, AD-53540.1, AD-53541.1, AD-53542.1, AD-53547.1, AD-53552.1) at 120 hours.

TABLE 5

IC$_{50}$s of select ALAS1 siRNA duplexes normalized to AD-1955

| DUPLEX ID | IC50 (nM) 24 hrs | IC50 (nM) 120 hrs |
|---|---|---|
| AD-53534.1 | 0.045 | 0.076 |
| AD-53536.1 | 0.049 | 0.105 |
| AD-53540.1 | 0.054 | 0.077 |
| AD-53541.1 | 0.032 | 0.062 |
| AD-53542.1 | 0.028 | 0.093 |
| AD-53547.1 | 0.03 | 0.062 |
| AD-53548.1 | 0.044 | 0.101 |
| AD-53550.1 | 0.085 | 0.152 |
| AD-53552.1 | 0.077 | 0.063 |
| AD-53567.1 | 0.219 | 0.357 |
| AD-53579.1 | 0.217 | 0.566 |

Example 4

In Vivo Silencing Using a Mouse/Rat ALAS1 siRNA Formulated as a LNP

The sequences of the modified duplex AD-53558 are shown in Table 6 below.

TABLE 6

Sequences of ALAS1 siRNA Duplex AD-53558.4

| SEQ ID NO: (sense) | SEQ ID NO: (anti-sense) | Start Position on transcript NM_020559.2 | Duplex Name | Sense Sequence (5'-3') | Antisense Sequence (5'-3') |
|---|---|---|---|---|---|
| 383 | 384 | 1184 | AD-53558 | cuGuGAAAuuuAcucuGAudTsdT | AUcAGAGuAAAUUUcAcAGdTsdT |

This duplex was formulated as a LNP11 formulation (see Table 10 above). The LNP-formulated AD-53558 siRNA was tested in in vivo in mice (N=25 animals; 5 animals per group) and rats (N=20 animals; 4 animals per group) and was confirmed to silence ALAS1 mRNA in vivo. The results are shown in FIG. 5 and FIG. 6.

Figure 5:
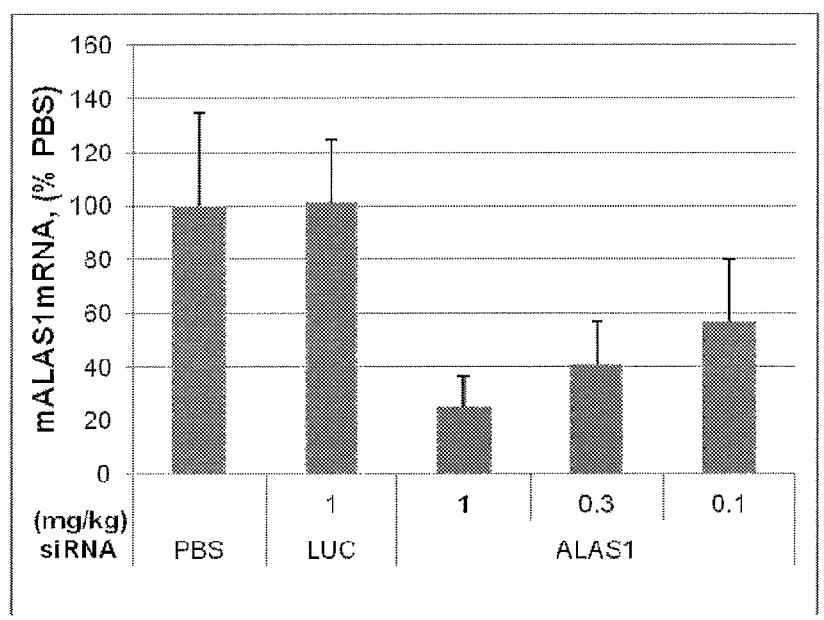
FIG. 5 shows the dose-response of the siRNA AD-53558 in suppressing mouse ALAS1 (mALAS1) mRNA relative to a PBS control. Results for a luciferase (LUC) AD-1955 control are also shown.

FIG. 5 shows that the siRNA demonstrated a dose-response effect in mice. The expression of mouse ALAS1 (mALAS1) mRNA was reduced by about 78% when the siRNA was administered at 1 mg/kg; mouse ALAS1 mRNA was reduced by about 60% when the siRNA was administered at 0.3 mg/kg; and mouse ALAS1 mRNA was reduced by about 49% when the siRNA was administered at 0.1 mg/kg. These reductions are expressed relative to a PBS control. An AD-1955 LUC control was also employed, as shown in FIG. 5.

Figure 6:
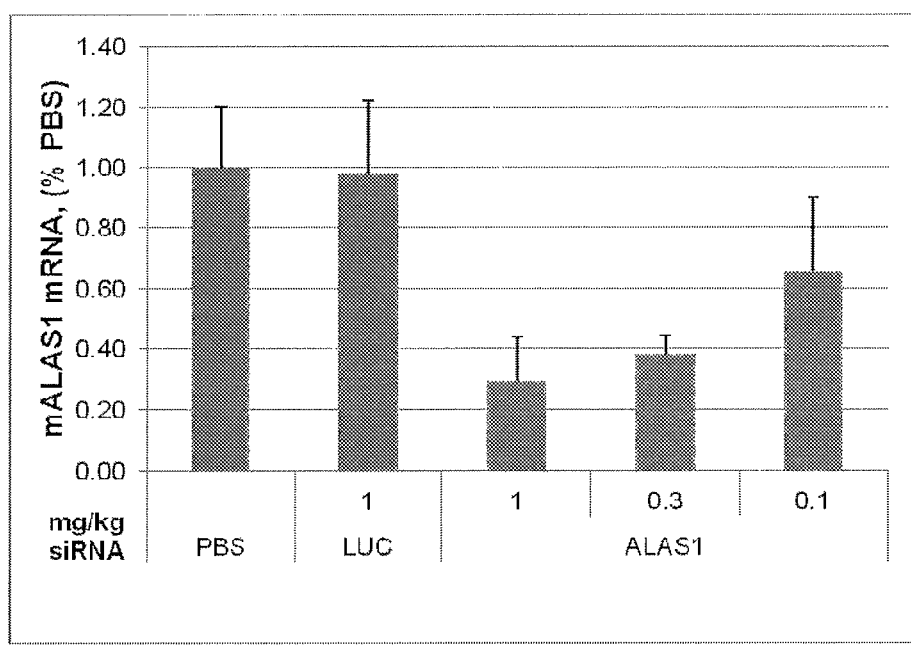
FIG. 6 shows the dose-response of the siRNA AD-53558 in suppressing ALAS1 mRNA in rats relative to a PBS control. Results for a luciferase (LUC) AD-1955 control are also shown.

Similarly, FIG. 6 shows that the siRNA demonstrated a dose-response effect in rats. The expression of ALAS1 RNA was reduced by about 70% when the when the siRNA was administered at 1 mg/kg; ALAS1 mRNA was reduced by about 62% when the siRNA was administered at 0.3 mg/kg; and ALAS1 mRNA was reduced by about 34% when the siRNA was administered at 0.1 mg/kg.

Figure 7:
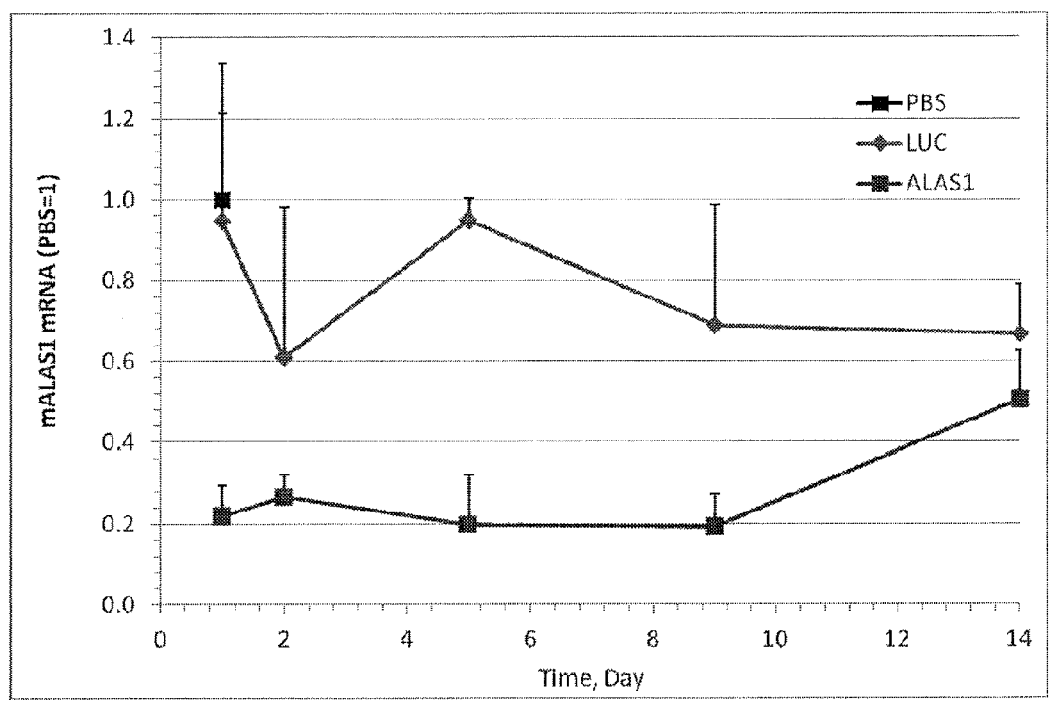
FIG. 7 shows the durability of suppression of mouse ALAS1 (mALAS1) mRNA by the siRNA AD-53558 relative to a PBS control.

The durability of silencing was also tested in mice (N=15; 3 animals per timepoint. The results are shown in FIG. 7, which shows that AD-53558 suppressed mALAS1 mRNA by about 80% for at least 9 days. Suppression of at least about 50% persisted for at least 14 days.

Example 5

Efficacy of ALAS1 siRNA in an Animal Model of AIP

The effects of the AD-53558 LNP11 formulation (a mouse/rat ALAS1 siRNA described in the previous example) were investigated in a mouse model of AIP. The PBGD knockout is not viable (−/−, 0% activity). Heterozygous PBGD knockout mice (+/−, ~50% activity) are available but do not have the full biochemical phenotype and thus do not recapitulate the human disease phenotype. Thus, a mouse model of AIP has been developed that is a compound heterozygote with T1/T2 alleles, including T1 (+/−) promoter disruption and T2 (−/−) splice-site alteration. These mice have been shown to have hepatic residual PBGD activity that is about ~30% of the wild-type level and normal or slightly elevated baseline plasma ALA and PBG levels. The mice have been found to appear normal early in life and to become slightly slower and ataxic with age. By six months of age, the mice have been documented to develop impaired motor coordination and muscular performance and axonal degeneration on pathological examination. Investigation of the pathology of the mouse model has shown axonal degeneration, impaired motor coordination and muscular performance in older mice. Urinary and plasma ALA and PBG have been found to markedly increase with serial i.p. administration of phenobarbital (see Lindberg et al., (1996), Nature Genetics, 12:195-219 and Lindberg et al., (1999), Journal of Clinical Investigation, 103:1127-34). The mice were rescued by AAV-mediated expression of PBGD in the liver (Yasuda et al. (2010), Molecular Medicine, 1:17-22 and Unzu et al. (2011), Molecular Medicine, 2:243-50).

On day 1, the mice were administered 1 mg/kg ALAS1 siRNA (n=5) or LUC AD-1955 control (n=3) by i.v. injection. Three phenobarbital injections were given (1 injection per day on days 2, 3, and 4) to induce hepatic ALAS1 and the porphyrin precursors, ALA and PBG. Plasma and overnight urine specimens were collected on day 5 and metabolite levels were measured by LC-MS. Metabolite levels were measured in plasma by LC-MS and were also measured in urine. Baseline levels of metabolites were measured prior to the first treatment on day 1. The results are shown in FIGS. 8-12 and in Tables 12 and 13.

Figure 8:
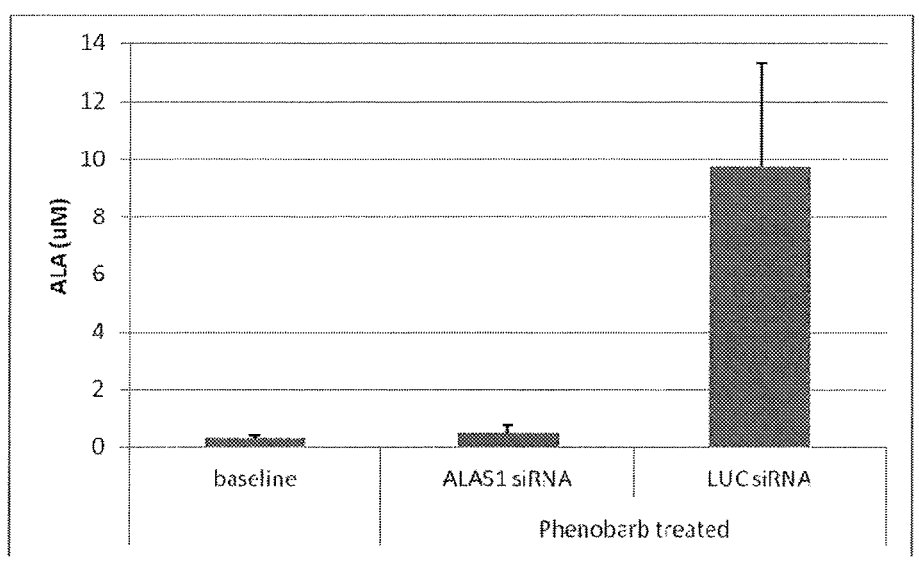
FIG. 8 shows means±standard deviations of plasma ALA levels (in µM) at baseline, and after phenobarbital treatment in the experimental (ALAS1 siRNA) and control (LUC siRNA) groups.
Figure 9:
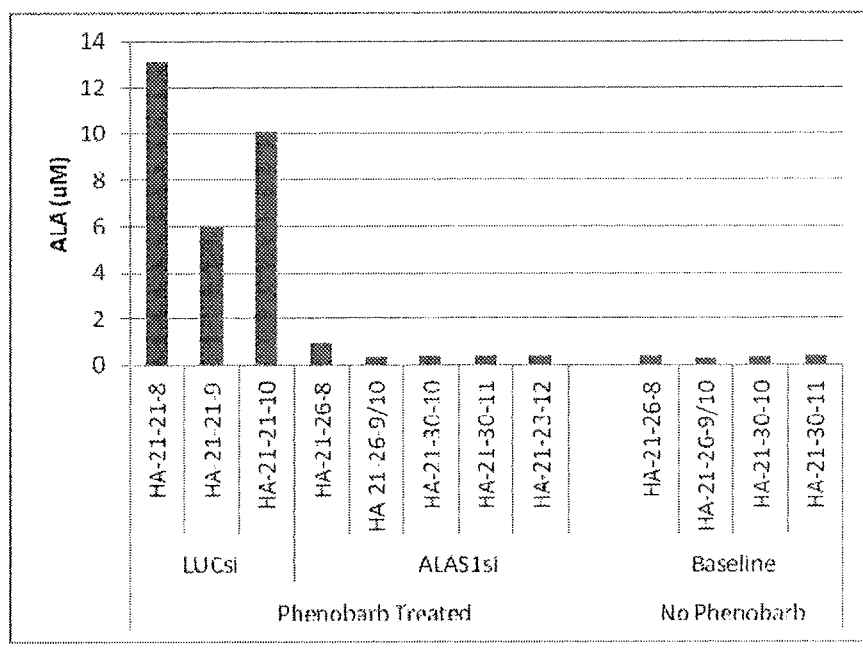
FIG. 9 shows the plasma ALA levels (in µM) of individual animals at baseline, and after phenobarbital treatment in animals that received ALAS1 siRNA and control (LUC siRNA) treatment.

FIG. 8 and FIG. 9 show the plasma ALA levels in μM. Baseline ALA levels were low, (n=4), and phenobarbital treatment induced significant increases in plasma ALA levels in the control LUC siRNA treated animals (n=3). Treatment with ALAS1 siRNA inhibited the induction of plasma ALA (n=5), as shown in FIG. 8. The ALAS1 siRNA was consistently effective in blocking the induction of plasma ALA in each of the individual animals studied (see FIG. 9). These results indicate that ALAS1 siRNA treatment was effective in preventing the increases in plasma ALA associated with the phenobarbital-induced acute attacks in this AIP animal model.

Figure 10:
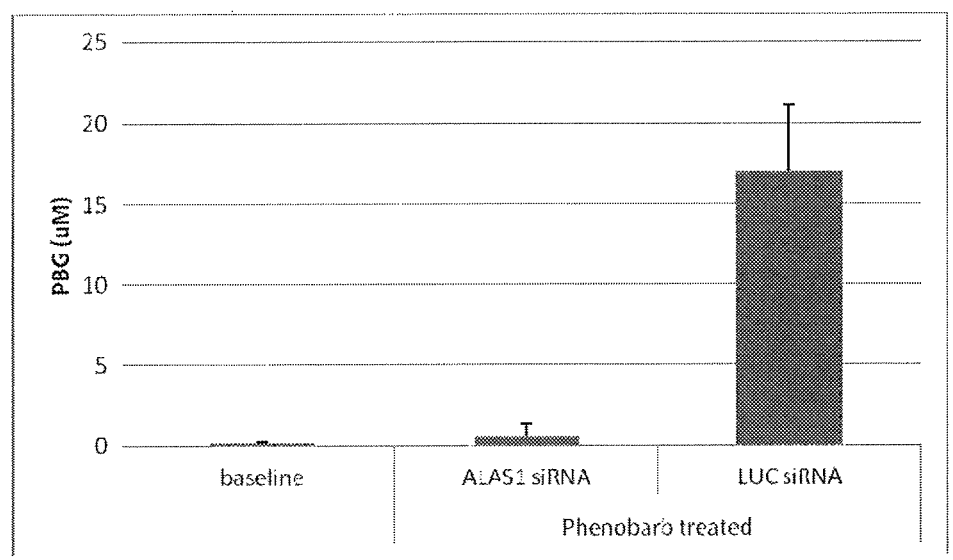
FIG. 10 shows means±standard deviations of plasma PBG levels (in µM) at baseline, and after phenobarbital treatment in animals that received ALAS1 siRNA and control (LUC siRNA) treatment.
Figure 11:
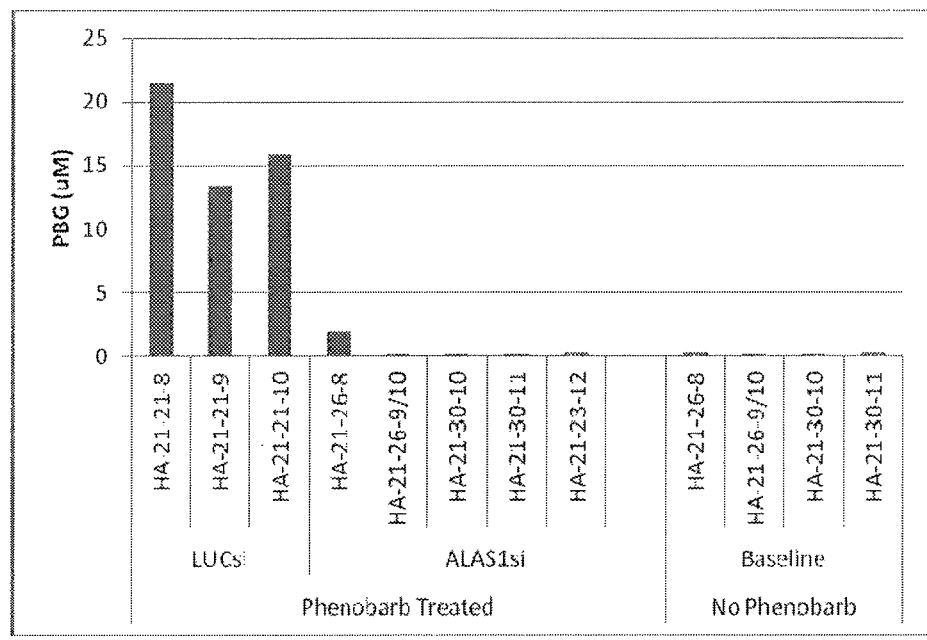
FIG. 11 shows the plasma PBG levels (in µM) of individual animals at baseline, and after phenobarbital treatment in animals that received ALAS1 siRNA and control (LUC siRNA) treatment.
Figure 12:
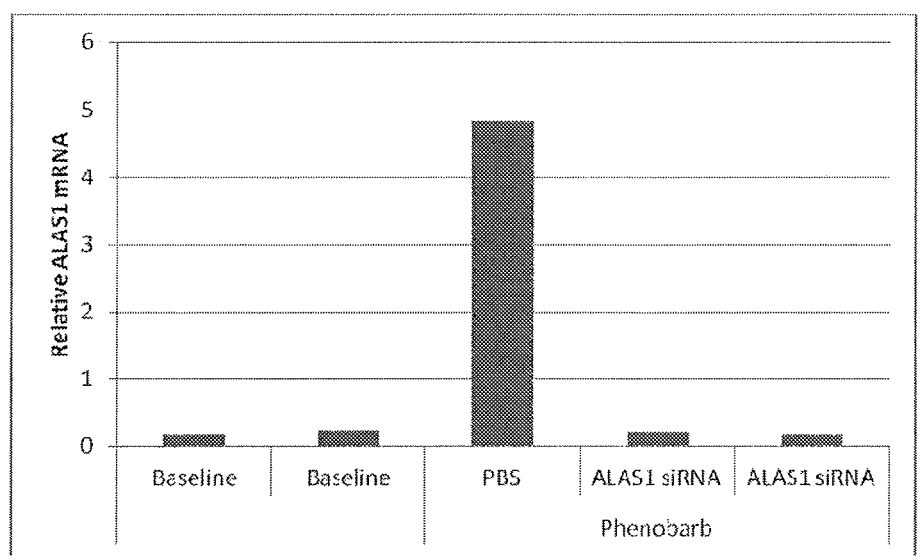
FIG. 12 shows the relative mALAS1mRNA level in liver at baseline, and after phenobarbital treatment in select representative experimental (ALAS1 siRNA) and control (PBS) animals.

FIG. 10 and FIG. 11 show the plasma PBG levels in μM. Baseline PBG levels were low (n=4), and phenobarbital treatment induced significant increases in plasma PBG levels in the control LUC siRNA treated animals (n=3) Treatment with ALAS1 siRNA inhibited the induction of plasma PBG (n=5), as shown in FIG. 10. The ALAS1 siRNA was consistently effective in blocking the induction of plasma PBG in each of the individual animals studied (see FIG. 11). These results indicate that ALAS1 siRNA treatment was effective in preventing the increases in plasma PBG associated with the phenobarbital-induced acute attacks in this AIP animal model.

Tables 12 and 13 shows urine ALA and PBG levels at baseline and after phenobarbital treatment in LUC siRNA (n=2) control (CTR, which refers to a PBS buffer treated animal, n=1) and ALAS1 siRNA (n=5) treated animals.

Phenobarbital treatment induced strong increases (~25-30 fold increases) in urine ALA (~9-fold over baseline levels) and PBG (~19-fold over baseline levels) in the LUC siRNA treated mice, control, whereas such increases were not observed in the ALAS1 siRNA treated animals. Thus, ALAS1 siRNA blocked phenobarbital-induced increases in urinary ALA and PBG. These results are consistent with the plasma measurements and show that ALAS1 siRNA treatment was effective in preventing increases in urinary metabolites (ALA and PBG) associated with the phenobarbital-induced acute attacks in this AIP animal model.

In further experiments (FIG. 12), it was found that phenobarbital treatment induced large increases (~25 fold) in ALAS1 mRNA expression in the liver of the mouse model. Administration of ALAS1 siRNA completely blocked this ALAS1 mRNA induction. These results provide further evidence that ALAS1 siRNA is effective in an animal model of AIP.

Collectively, the results provided in this Example show that ALAS1 siRNA was effective in treating acute attacks in an animal model of the acute hepatic porphyria AIP. Multiple outcome measures support this conclusion, including plasma ALA levels, plasma PBG levels, urine ALA levels, urine PBG levels, and liver ALAS1 mRNA expression levels.

TABLE 12

Urine data from individual animals showing prevention of induced acute attack

| Mouse ID | ALA (micro M/l) | PBG (micro M/L) | Creatinine (mg/dl) | ALA (microM/mg creatinine) | PBG (microM/mg creatinine) | siRNA | PB |
|---|---|---|---|---|---|---|---|
| Ha-17-4-6 | | | | 29.7 | 7.9 | Baseline | − |
| Ha-19-5-4/2 | | | | 15.7 | 5.1 | Baseline | − |
| Ha-20-39-4/3 | | | | 28.6 | 6.7 | Baseline | − |
| Ha-20-38-4 | | | | 21.4 | 4.7 | Baseline | − |
| Ha-21-33-4 | 934.92 | 483.71 | 0.4205 | 222.33 | 115.03 | Luc | + |
| Ha-21-36-9 | 944.08 | 563.53 | 0.5055 | 186.76 | 111.48 | Luc | + |
| Ha-21-18-8 | 32.88 | 8.69 | 0.133 | 24.72 | 6.53 | ALAS1; 1 mg/kg | + |
| Ha-21-33-7 | 83.07 | 23.28 | 0.426 | 19.50 | 5.46 | ALAS1; 1 mg/kg | + |
| Ha-21-34-5 | 59.15 | 18.41 | 0.263 | 22.49 | 7.00 | ALAS1; 1 mg/kg | + |

PB stands for phenobarbital.
A "+" indicates that phenobarbital was administered.

TABLE 13

Average Urine Data

| Mean ALA (microM/mg creatinine) | Mean PBG (microM/mg creatinine) | |
|---|---|---|
| 23.8 | 6.1 | AIP Baseline |
| 204.55 | 113.26 | Luc-siRNA |
| 22.24 | 6.33 | ALAS1-siRNA |

Example 6

In Vivo Silencing Using GalNAc-Conjugated Mouse ALAS1 siRNA

The experiments described in this example investigated the in vivo efficacy of three GalNAc-conjugated siRNAs (see Table 7). These siRNAs were designed and produced with methods such as those described in Example 2.

TABLE 7

Sequences AD-57929

| SEQ ID NO: (sense) | SEQ ID NO: (anti-sense) | Position of sense seq. on transcript NM_020559.2 | Duplex Name | Sense Sequence (5'-3') | Antisense Sequence (5'-3') | Position of antisense seq. on transcript NM_020559.2 |
|---|---|---|---|---|---|---|
| 385 | 386 | 775-795 | AD-56211 | AfaGfuCfuGfuUfUfCfcAfcUfuUfuCfaAfL96 | uUfgAfaAfaGfuGfgaaAfcAfgAfcUfusUfsg | 773-795 |
| 387 | 388 | 2168-2188 | AD-56173 | AfcAfuAfgUfaGfCfCfaGfaAfuUfgUfcUfL96 | aGfaCfaAfuUfcUfggcUfaCfuAfuGfusGfsg | 2166-2188 |
| 389 | 390 | 775-795 | AD-57929 | AfsasGfuCfuGfuUfUfCfcAfcUfuUfuCfaAfL96 | usUfsgAfaAfaGfuGfgaaAfcAfgAfcUfususg | 773-795 |

Figure 13:
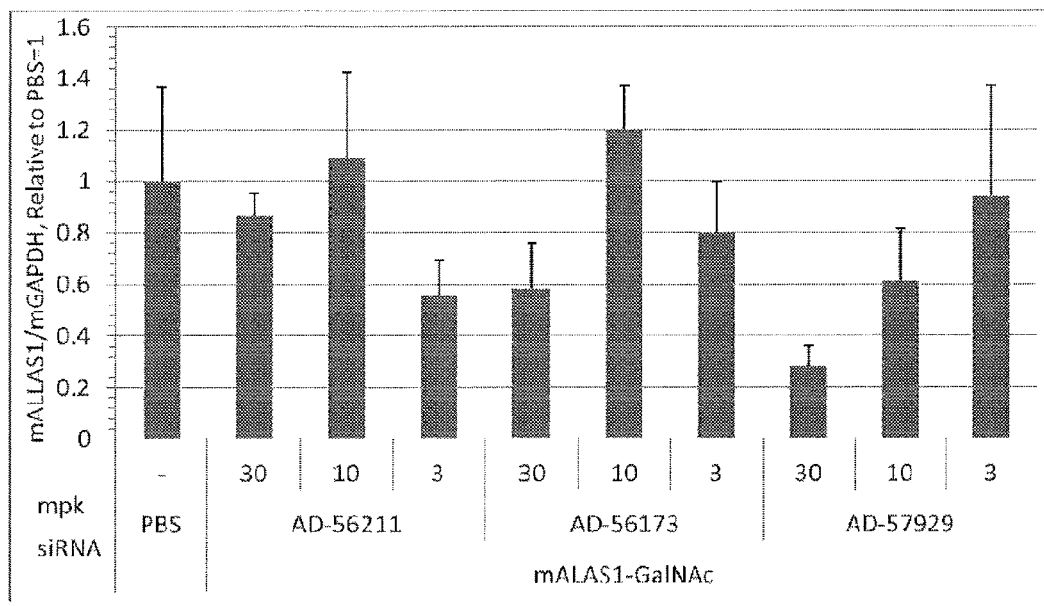
FIG. 13 shows the effects of three GalNAc conjugated mALAS1 siRNAs on mALAS1 expression (relative to a PBS control) in mouse liver tissue.

The mice (n=40; n=4 per experimental condition) were divided into groups that received PBS or doses of 3 mg/kg, 10 mg/kg, or 30 mg/kg of siRNA administered subcutaneously. The level of mALAS1/mGAPDH mRNA, relative to the PBS control, was determined in liver cells at 72 hours post-administration. The results are shown in FIG. 13. There was not a clear dose-response effect for the siRNAs AD-56211 and AD-56173. In contrast, the ALAS1 siRNA AD-57929 showed a dose-response effect in inhibiting mALAS1 expression. These results demonstrate that an ALAS1 GalNAc conjugate was effective in inhibiting expression of ALAS1 mRNA in vivo and showed a dose-response effect.

Example 7

Human siRNAs

Additional human siRNAs were designed and produced as described in Example 2. The top 45 siRNAs were selected based on their predicted efficacy. The sequences of these 45 siRNAs are provided in Table 8.

TABLE 8

Human ALAS1 siRNA Sense and Antisense Sequences

| SEQ ID NO: (sense) | SEQ ID NO: (antisense) | Position on transcript NM_000688.4 | Sense Sequence (5'-3') | Antisense Sequence (5'-3') |
|---|---|---|---|---|
| 391 | 392 | 1635-1657 | CAUGCCAAAAAUGGACAUCAU | AUGAUGUCCAUUUUUGGCAUGAC |
| 393 | 394 | 2352-2374 | UAAAUUUUAAUCUAUAGUAAA | UUUACUAUAGAUUAAAAUUUAAU |
| 395 | 396 | 1324-1346 | GGCUGUGAGAUUUACUCUGAU | AUCAGAGUAAAUCUCACAGCCUG |
| 397 | 398 | 1637-1659 | UGCCAAAAAUGGACAUCAUUU | AAAUGAUGUCCAUUUUUGGCAUG |
| 399 | 400 | 1363-1385 | AUGAUCCAAGGGAUUCGAAAC | GUUUCGAAUCCCUUGGAUCAUGG |
| 401 | 402 | 925-947 | ACUUUUCAGUAUGAUCGUUUC | GAAACGAUCAUACUGAAAAGUGG |
| 403 | 404 | 790-812 | CCCAGUGUGGUUAGUGUGAAA | UUUCACACUAACCACACUGGGGC |
| 405 | 406 | 1531-1553 | UGUGAUGUGGCCCAUGAGUUU | AAACUCAUGGGCCACAUCACACA |
| 407 | 408 | 2189-2211 | AUUUUGAAGUGAUGAGUGAAA | UUUCACUCAUCACUUCAAAAUGC |
| 409 | 410 | 929-951 | UUCAGUAUGAUCGUUUCUUUG | CAAAGAAACGAUCAUACUGAAAA |
| 411 | 412 | 872-894 | GACCAGAAAGAGUGUCUCAUC | GAUGAGACACUCUUUCUGGUCUU |
| 413 | 414 | 706-728 | UUCUGCAAAGCCAGUCUUGAG | CUCAAGACUGGCUUUGCAGAAGA |
| 415 | 416 | 1362-1384 | CAUGAUCCAAGGGAUUCGAAA | UUUCGAAUCCCUUGGAUCAUGGA |
| 417 | 418 | 1634-1656 | UCAUGCCAAAAAUGGACAUCA | UGAUGUCCAUUUUUGGCAUGACU |

TABLE 8-continued

Human ALAS1 siRNA Sense and Antisense Sequences

| SEQ ID NO: (sense) | SEQ ID NO: (antisense) | Position on transcript NM_000688.4 | Sense Sequence (5'-3') | Antisense Sequence (5'-3') |
|---|---|---|---|---|
| 419 | 420 | 1325-1347 | GCUGUGAGAUUUACUCUGAUU | AAUCAGAGUAAAUCUCACAGCCU |
| 421 | 422 | 2208-2230 | AAGAGAGAAGUCCUAUUUCUC | GAGAAAUAGGACUUCUCUCUUUC |
| 423 | 424 | 2344-2366 | AGUUAUAUUAAAUUUUAAUCU | AGAUUAAAAUUUAAUAUAACUUA |
| 425 | 426 | 924-946 | CACUUUUCAGUAUGAUCGUUU | AAACGAUCAUACUGAAAAGUGGA |
| 427 | 428 | 873-895 | ACCAGAAAGAGUGUCUCAUCU | AGAUGAGACACUCUUUCUGGUCU |
| 429 | 430 | 759-781 | GAGGAAAGAGGUUGCUGAAAC | GUUUCAGCAACCUCUUUCCUCAC |
| 431 | 432 | 871-893 | AGACCAGAAAGAGUGUCUCAU | AUGAGACACUCUUUCUGGUCUUU |
| 433 | 434 | 1183-1205 | AAUAUUUCUGGAACUAGUAAA | UUUACUAGUUCCAGAAAUAUUUC |
| 435 | 436 | 2229-2251 | AGGCUUGAGCAAGUUGGUAUC | GAUACCAACUUGCUCAAGCCUGA |
| 437 | 438 | 671-693 | UGGCAGCACAGAUGAAUCAGA | UCUGAUUCAUCUGUGCUGCCAGG |
| 439 | 440 | 2187-2209 | GCAUUUUGAAGUGAUGAGUGA | UCACUCAUCACUUCAAAAUGCAG |
| 441 | 442 | 913-935 | AAAUCUGUUUCCACUUUUCAG | CUGAAAAGUGGAAACAGAUUUUG |
| 443 | 444 | 1977-1999 | ACUAAUGAGCAGACAUAACAU | AUGUUAUGUCUGCUCAUUAGUUC |
| 445 | 446 | 1174-1196 | GGUACUAGAAAUAUUUCUGGA | UCCAGAAAUAUUUCUAGUACCAC |
| 447 | 448 | 1810-1832 | AUCCUGAAGAGCGCUGAGGGA | UCCCUCAGCGCUCUUCAGGAUCC |
| 449 | 450 | 892-914 | CUUCUUCAAGAUAACUUGCCA | UGGCAAGUUAUCUUGAAGAAGAU |
| 451 | 452 | 877-899 | GAAAGAGUGUCUCAUCUUCUU | AAGAAGAUGAGACACUCUUUCUG |
| 453 | 454 | 935-957 | AUGAUCGUUUCUUUGAGAAAA | UUUUCUCAAAGAAACGAUCAUAC |
| 455 | 456 | 1975-1997 | GAACUAAUGAGCAGACAUAAC | GUUAUGUCUGCUCAUUAGUUCAU |
| 457 | 458 | 1478-1500 | CAUUUGAAACUGUCCAUUCAA | UUGAAUGGACAGUUUCAAAUGCC |
| 459 | 460 | 2366-2388 | UAGUAAAAACAUAGUCCUGGA | UCCAGGACUAUGUUUUUACUAUA |
| 461 | 462 | 853-875 | GACAUCAUGCAAAAGCAAAGA | UCUUUGCUUUUGCAUGAUGUCCU |
| 463 | 464 | 1966-1988 | GUCUGUGAUGAACUAAUGAGC | GCUCAUUAGUUCAUCACAGACUU |
| 465 | 466 | 928-950 | UUUCAGUAUGAUCGUUUCUUU | AAAGAAACGAUCAUACUGAAAAG |
| 467 | 468 | 1186-1208 | AUUUCUGGAACUAGUAAAUUC | GAAUUUACUAGUUCCAGAAAUAU |
| 469 | 470 | 1189-1211 | UCUGGAACUAGUAAAUUCCAU | AUGGAAUUUACUAGUUCCAGAAA |
| 471 | 472 | 973-995 | AAUGACCACACCUAUCGAGUU | AACUCGAUAGGUGUGGUCAUUCU |
| 473 | 474 | 983-1005 | CCUAUCGAGUUUUUAAAACUG | CAGUUUUAAAAACUCGAUAGGUG |
| 475 | 476 | 1185-1207 | UAUUUCUGGAACUAGUAAAUU | AAUUUACUAGUUCCAGAAAUAUU |
| 477 | 478 | 2353-2375 | AAAUUUUAAUCUAUAGUAAAA | UUUUACUAUAGAUUAAAAUUUAA |
| 479 | 480 | 875-897 | CAGAAAGAGUGUCUCAUCUUC | GAAGAUGAGACACUCUUUCUGGU |
| 481 | 482 | 360-378 | GCCCAUUCUUAUCCCGAGU | ACUCGGGAUAAGAAUGGGC |
| 483 | 484 | 428-446 | CAAAACUGCCCCAAGAUGA | UCAUCUUGGGGCAGUUUUG |
| 485 | 486 | 873-891 | CAGAAAGAGUGUCUCAUCU | AGAUGAGACACUCUUUCUG |
| 487 | 488 | 874-892 | AGAAAGAGUGUCUCAUCUU | AAGAUGAGACACUCUUUCU |
| 489 | 490 | 877-895 | AAGAGUGUCUCAUCUUCUU | AAGAAGAUGAGACACUCUU |

TABLE 8-continued

Human ALAS1 siRNA Sense and Antisense Sequences

| SEQ ID NO: (sense) | SEQ ID NO: (anti-sense) | Position on transcript NM_000688.4 | Sense Sequence (5'-3') | Antisense Sequence (5'-3') |
|---|---|---|---|---|
| 491 | 492 | 1295-1313 | CUCUUCACCCUGGCUAAGA | UCUUAGCCAGGGUGAAGAG |
| 493 | 494 | 1296-1314 | UCUUCACCCUGGCUAAGAU | AUCUUAGCCAGGGUGAAGA |
| 495 | 496 | 1299-1317 | UCACCCUGGCUAAGAUGAU | AUCAUCUUAGCCAGGGUGA |
| 497 | 498 | 1347-1365 | GGAACCAUGCCUCCAUGAU | AUCAUGGAGGCAUGGUUCC |
| 499 | 500 | 1355-1373 | GCCUCCAUGAUCCAAGGGA | UCCCUUGGAUCAUGGAGGC |
| 501 | 502 | 1356-1374 | CCUCCAUGAUCCAAGGGAU | AUCCCUUGGAUCAUGGAGG |
| 503 | 504 | 1357-1375 | CUCCAUGAUCCAAGGGAUU | AAUCCCUUGGAUCAUGGAG |
| 505 | 506 | 1631-1649 | GUCAUGCCAAAAAUGGACA | UGUCCAUUUUUGGCAUGAC |
| 507 | 508 | 1634-1652 | AUGCCAAAAAUGGACAUCA | UGAUGUCCAUUUUUGGCAU |
| 509 | 510 | 1635-1653 | UGCCAAAAAUGGACAUCAU | AUGAUGUCCAUUUUUGGCA |
| 511 | 512 | 1791-1809 | CCCUGGAGUCUGUGCGGAU | AUCCGCACAGACUCCAGGG |
| 513 | 514 | 1794-1812 | UGGAGUCUGUGCGGAUCCU | AGGAUCCGCACAGACUCCA |
| 515 | 516 | 1921-1939 | CAUCAUCCCUGUGCGGGUU | AACCCGCACAGGGAUGAUG |
| 517 | 518 | 359-377 | UGCCCAUUCUUAUCCCGAA | UUCGGGAUAAGAAUGGGCA |
| 519 | 520 | 362-380 | CCAUUCUUAUCCCGAGUCA | UGACUCGGGAUAAGAAUGG |
| 521 | 522 | 363-381 | CAUUCUUAUCCCGAGUCCA | UGGACUCGGGAUAAGAAUG |
| 523 | 524 | 434-452 | UGCCCCAAGAUGAUGGAAU | AUUCCAUCAUCUUGGGGCA |
| 525 | 526 | 872-890 | CCAGAAAGAGUGUCUCAUA | UAUGAGACACUCUUUCUGG |
| 527 | 528 | 875-893 | GAAAGAGUGUCUCAUCUUA | UAAGAUGAGACACUCUUUC |
| 529 | 530 | 1112-1130 | CACCCACGGGUGUGUGGGA | UCCCACACACCCGUGGGUG |
| 531 | 532 | 1113-1131 | ACCCACGGGUGUGUGGGGA | UCCCCACACACCCGUGGGU |
| 533 | 534 | 1297-1315 | CUUCACCCUGGCUAAGAUA | UAUCUUAGCCAGGGUGAAG |
| 535 | 536 | 1300-1318 | CACCCUGGCUAAGAUGAUA | UAUCAUCUUAGCCAGGGUG |
| 537 | 538 | 1301-1319 | ACCCUGGCUAAGAUGAUGA | UCAUCAUCUUAGCCAGGGU |
| 539 | 540 | 1348-1366 | GAACCAUGCCUCCAUGAUA | UAUCAUGGAGGCAUGGUUC |
| 541 | 542 | 1481-1499 | GAAACUGUCCAUUCAAUGA | UCAUUGAAUGGACAGUUUC |
| 543 | 544 | 1786-1804 | UGGAGCCCUGGAGUCUGUA | UACAGACUCCAGGGCUCCA |
| 545 | 546 | 1795-1813 | GGAGUCUGUGCGGAUCCUA | UAGGAUCCGCACAGACUCC |
| 547 | 548 | 1919-1937 | CACAUCAUCCCUGUGCGGA | UCCGCACAGGGAUGAUGUG |
| 549 | 550 | 1922-1940 | AUCAUCCCUGUGCGGGUUA | UAACCCGCACAGGGAUGAU |
| 551 | 552 | 1923-1941 | UCAUCCCUGUGCGGGUUGA | UCAACCCGCACAGGGAUGA |

Example 8

Human siRNAs

Additional 19mer human siRNAs were generated. The sequences of these siRNAs are provided in Table 9. These siRNAs can be tested for efficacy using methods described herein and/or methods known in the art.

TABLE 9

Human ALAS1 siRNA Sense and Antisense Sequences

| SEQ ID NO: (sense) | SEQ ID NO: (antisense) | Position on transcript NM_000688.4 | Sense Sequence (5'-3') | Antisense Sequence (5'-3') |
|---|---|---|---|---|
| 553 | 554 | 4-22 | UAUAUUAAGGCGCCGGCGA | UCGCCGGCGCCUUAAUAUA |
| 555 | 556 | 5-23 | AUAUUAAGGCGCCGGCGAU | AUCGCCGGCGCCUUAAUAU |
| 557 | 558 | 6-24 | UAUUAAGGCGCCGGCGAUC | GAUCGCCGGCGCCUUAAUA |
| 559 | 560 | 7-25 | AUUAAGGCGCCGGCGAUCG | CGAUCGCCGGCGCCUUAAU |
| 561 | 562 | 8-26 | UUAAGGCGCCGGCGAUCGC | GCGAUCGCCGGCGCCUUAA |
| 563 | 564 | 9-27 | UAAGGCGCCGGCGAUCGCG | CGCGAUCGCCGGCGCCUUA |
| 565 | 566 | 10-28 | AAGGCGCCGGCGAUCGCGG | CCGCGAUCGCCGGCGCCUU |
| 567 | 568 | 11-29 | AGGCGCCGGCGAUCGCGGC | GCCGCGAUCGCCGGCGCCU |
| 569 | 570 | 12-30 | GGCGCCGGCGAUCGCGGCC | GGCCGCGAUCGCCGGCGCC |
| 571 | 572 | 13-31 | GCGCCGGCGAUCGCGGCCU | AGGCCGCGAUCGCCGGCGC |
| 573 | 574 | 14-32 | CGCCGGCGAUCGCGGCCUG | CAGGCCGCGAUCGCCGGCG |
| 575 | 576 | 81-99 | CUUGAGUGCCCGCCUCCUU | AAGGAGGCGGGCACUCAAG |
| 577 | 578 | 82-100 | UUGAGUGCCCGCCUCCUUC | GAAGGAGGCGGGCACUCAA |
| 579 | 580 | 83-101 | UGAGUGCCCGCCUCCUUCG | CGAAGGAGGCGGGCACUCA |
| 581 | 582 | 84-102 | GAGUGCCCGCCUCCUUCGC | GCGAAGGAGGCGGGCACUC |
| 583 | 584 | 85-103 | AGUGCCCGCCUCCUUCGCC | GGCGAAGGAGGCGGGCACU |
| 585 | 586 | 86-104 | GUGCCCGCCUCCUUCGCCG | CGGCGAAGGAGGCGGGCAC |
| 587 | 588 | 87-105 | UGCCCGCCUCCUUCGCCGC | GCGGCGAAGGAGGCGGGCA |
| 589 | 590 | 88-106 | GCCCGCCUCCUUCGCCGCC | GGCGGCGAAGGAGGCGGGC |
| 591 | 592 | 89-107 | CCCGCCUCCUUCGCCGCCG | CGGCGGCGAAGGAGGCGGG |
| 593 | 594 | 90-108 | CCGCCUCCUUCGCCGCCGC | GCGGCGGCGAAGGAGGCGG |
| 595 | 596 | 91-109 | CGCCUCCUUCGCCGCCGCC | GGCGGCGGCGAAGGAGGCG |
| 597 | 598 | 92-110 | GCCUCCUUCGCCGCCGCCU | AGGCGGCGGCGAAGGAGGC |
| 599 | 600 | 93-111 | CCUCCUUCGCCGCCGCCUC | GAGGCGGCGGCGAAGGAGG |
| 601 | 602 | 356-374 | CGCUGCCCAUUCUUAUCCC | GGGAUAAGAAUGGGCAGCG |
| 603 | 604 | 357-375 | GCUGCCCAUUCUUAUCCCG | CGGGAUAAGAAUGGGCAGC |
| 605 | 606 | 359-377 | UGCCCAUUCUUAUCCCGAG | CUCGGGAUAAGAAUGGGCA |
| 607 | 608 | 361-379 | CCCAUUCUUAUCCCGAGUC | GACUCGGGAUAAGAAUGGG |
| 609 | 610 | 362-380 | CCAUUCUUAUCCCGAGUCC | GGACUCGGGAUAAGAAUGG |
| 611 | 612 | 363-381 | CAUUCUUAUCCCGAGUCCC | GGGACUCGGGAUAAGAAUG |
| 613 | 614 | 364-382 | AUUCUUAUCCCGAGUCCCC | GGGGACUCGGGAUAAGAAU |

TABLE 9-continued

Human ALAS1 siRNA Sense and Antisense Sequences

| SEQ ID NO: (sense) | SEQ ID NO: (anti-sense) | Position on transcript NM_000688.4 | Sense Sequence (5'-3') | Antisense Sequence (5'-3') |
|---|---|---|---|---|
| 615 | 616 | 365-383 | UUCUUAUCCCGAGUCCCCC | GGGGGACUCGGGAUAAGAA |
| 617 | 618 | 366-384 | UCUUAUCCCGAGUCCCCCA | UGGGGGACUCGGGAUAAGA |
| 619 | 620 | 367-385 | CUUAUCCCGAGUCCCCCAG | CUGGGGGACUCGGGAUAAG |
| 621 | 622 | 368-386 | UUAUCCCGAGUCCCCCAGG | CCUGGGGGACUCGGGAUAA |
| 623 | 624 | 369-387 | UAUCCCGAGUCCCCCAGGC | GCCUGGGGGACUCGGGAUA |
| 625 | 626 | 370-388 | AUCCCGAGUCCCCCAGGCC | GGCCUGGGGGACUCGGGAU |
| 627 | 628 | 371-389 | UCCCGAGUCCCCCAGGCCU | AGGCCUGGGGGACUCGGGA |
| 629 | 630 | 372-390 | CCCGAGUCCCCCAGGCCUU | AAGGCCUGGGGGACUCGGG |
| 631 | 632 | 373-391 | CCGAGUCCCCCAGGCCUUU | AAAGGCCUGGGGGACUCGG |
| 633 | 634 | 374-392 | CGAGUCCCCCAGGCCUUUC | GAAAGGCCUGGGGGACUCG |
| 635 | 636 | 375-393 | GAGUCCCCCAGGCCUUUCU | AGAAAGGCCUGGGGGACUC |
| 637 | 638 | 376-394 | AGUCCCCCAGGCCUUUCUG | CAGAAAGGCCUGGGGGACU |
| 639 | 640 | 377-395 | GUCCCCCAGGCCUUUCUGC | GCAGAAAGGCCUGGGGGAC |
| 641 | 642 | 378-396 | UCCCCCAGGCCUUUCUGCA | UGCAGAAAGGCCUGGGGGA |
| 643 | 644 | 379-397 | CCCCCAGGCCUUUCUGCAG | CUGCAGAAAGGCCUGGGGG |
| 645 | 646 | 380-398 | CCCCAGGCCUUUCUGCAGA | UCUGCAGAAAGGCCUGGGG |
| 647 | 648 | 381-399 | CCCAGGCCUUUCUGCAGAA | UUCUGCAGAAAGGCCUGGG |
| 649 | 650 | 382-400 | CCAGGCCUUUCUGCAGAAA | UUUCUGCAGAAAGGCCUGG |
| 651 | 652 | 383-401 | CAGGCCUUUCUGCAGAAAG | CUUUCUGCAGAAAGGCCUG |
| 653 | 654 | 384-402 | AGGCCUUUCUGCAGAAAGC | GCUUUCUGCAGAAAGGCCU |
| 655 | 656 | 385-403 | GGCCUUUCUGCAGAAAGCA | UGCUUUCUGCAGAAAGGCC |
| 657 | 658 | 386-404 | GCCUUUCUGCAGAAAGCAG | CUGCUUUCUGCAGAAAGGC |
| 659 | 660 | 387-405 | CCUUUCUGCAGAAAGCAGG | CCUGCUUUCUGCAGAAAGG |
| 661 | 662 | 388-406 | CUUUCUGCAGAAAGCAGGC | GCCUGCUUUCUGCAGAAAG |
| 663 | 664 | 389-407 | UUUCUGCAGAAAGCAGGCA | UGCCUGCUUUCUGCAGAAA |
| 665 | 666 | 390-408 | UUCUGCAGAAAGCAGGCAA | UUGCCUGCUUUCUGCAGAA |
| 667 | 668 | 391-409 | UCUGCAGAAAGCAGGCAAA | UUUGCCUGCUUUCUGCAGA |
| 669 | 670 | 392-410 | CUGCAGAAAGCAGGCAAAU | AUUUGCCUGCUUUCUGCAG |
| 671 | 672 | 393-411 | UGCAGAAAGCAGGCAAAUC | GAUUUGCCUGCUUUCUGCA |
| 673 | 674 | 394-412 | GCAGAAAGCAGGCAAAUCU | AGAUUUGCCUGCUUUCUGC |
| 675 | 676 | 395-413 | CAGAAAGCAGGCAAAUCUC | GAGAUUUGCCUGCUUUCUG |
| 677 | 678 | 396-414 | AGAAAGCAGGCAAAUCUCU | AGAGAUUUGCCUGCUUUCU |
| 679 | 680 | 397-415 | GAAAGCAGGCAAAUCUCUG | CAGAGAUUUGCCUGCUUUC |
| 681 | 682 | 398-416 | AAAGCAGGCAAAUCUCUGU | ACAGAGAUUUGCCUGCUUU |
| 683 | 684 | 399-417 | AAGCAGGCAAAUCUCUGUU | AACAGAGAUUUGCCUGCUU |
| 685 | 686 | 400-418 | AGCAGGCAAAUCUCUGUUG | CAACAGAGAUUUGCCUGCU |

TABLE 9-continued

Human ALAS1 siRNA Sense and Antisense Sequences

| SEQ ID NO: (sense) | SEQ ID NO: (antisense) | Position on transcript NM_000688.4 | Sense Sequence (5'-3') | Antisense Sequence (5'-3') |
|---|---|---|---|---|
| 687 | 688 | 401-419 | GCAGGCAAAUCUCUGUUGU | ACAACAGAGAUUUGCCUGC |
| 689 | 690 | 402-420 | CAGGCAAAUCUCUGUUGUU | AACAACAGAGAUUUGCCUG |
| 691 | 692 | 403-421 | AGGCAAAUCUCUGUUGUUC | GAACAACAGAGAUUUGCCU |
| 693 | 694 | 405-423 | GCAAAUCUCUGUUGUUCUA | UAGAACAACAGAGAUUUGC |
| 695 | 696 | 406-424 | CAAAUCUCUGUUGUUCUAU | AUAGAACAACAGAGAUUUG |
| 697 | 698 | 407-425 | AAAUCUCUGUUGUUCUAUG | CAUAGAACAACAGAGAUUU |
| 699 | 700 | 408-426 | AAUCUCUGUUGUUCUAUGC | GCAUAGAACAACAGAGAUU |
| 701 | 702 | 409-427 | AUCUCUGUUGUUCUAUGCC | GGCAUAGAACAACAGAGAU |
| 703 | 704 | 410-428 | UCUCUGUUGUUCUAUGCCC | GGGCAUAGAACAACAGAGA |
| 705 | 706 | 411-429 | CUCUGUUGUUCUAUGCCCA | UGGGCAUAGAACAACAGAG |
| 707 | 708 | 412-430 | UCUGUUGUUCUAUGCCCAA | UUGGGCAUAGAACAACAGA |
| 709 | 710 | 413-431 | CUGUUGUUCUAUGCCCAAA | UUUGGGCAUAGAACAACAG |
| 711 | 712 | 414-432 | UGUUGUUCUAUGCCCAAAA | UUUUGGGCAUAGAACAACA |
| 713 | 714 | 415-433 | GUUGUUCUAUGCCCAAAAC | GUUUUGGGCAUAGAACAAC |
| 715 | 716 | 416-434 | UUGUUCUAUGCCCAAAACU | AGUUUUGGGCAUAGAACAA |
| 717 | 718 | 417-435 | UGUUCUAUGCCCAAAACUG | CAGUUUUGGGCAUAGAACA |
| 719 | 720 | 418-436 | GUUCUAUGCCCAAAACUGC | GCAGUUUUGGGCAUAGAAC |
| 721 | 722 | 419-437 | UUCUAUGCCCAAAACUGCC | GGCAGUUUUGGGCAUAGAA |
| 723 | 724 | 420-438 | UCUAUGCCCAAAACUGCCC | GGGCAGUUUUGGGCAUAGA |
| 725 | 726 | 421-439 | CUAUGCCCAAAACUGCCCC | GGGGCAGUUUUGGGCAUAG |
| 727 | 728 | 422-440 | UAUGCCCAAAACUGCCCCA | UGGGGCAGUUUUGGGCAUA |
| 729 | 730 | 423-441 | AUGCCCAAAACUGCCCCAA | UUGGGGCAGUUUUGGGCAU |
| 731 | 732 | 424-442 | UGCCCAAAACUGCCCCAAG | CUUGGGGCAGUUUUGGGCA |
| 733 | 734 | 425-443 | GCCCAAAACUGCCCCAAGA | UCUUGGGGCAGUUUUGGGC |
| 735 | 736 | 426-444 | CCCAAAACUGCCCCAAGAU | AUCUUGGGGCAGUUUUGGG |
| 737 | 738 | 427-445 | CCAAAACUGCCCCAAGAUG | CAUCUUGGGGCAGUUUUGG |
| 739 | 740 | 429-447 | AAACUGCCCCAAGAUGAU | AUCAUCUUGGGGCAGUUUU |
| 741 | 742 | 430-448 | AAACUGCCCCAAGAUGAUG | CAUCAUCUUGGGGCAGUUU |
| 743 | 744 | 431-449 | AACUGCCCCAAGAUGAUGG | CCAUCAUCUUGGGGCAGUU |
| 745 | 746 | 432-450 | ACUGCCCCAAGAUGAUGGA | UCCAUCAUCUUGGGGCAGU |
| 747 | 748 | 433-451 | CUGCCCCAAGAUGAUGGAA | UUCCAUCAUCUUGGGGCAG |
| 749 | 750 | 434-452 | UGCCCCAAGAUGAUGGAAG | CUUCCAUCAUCUUGGGGCA |
| 751 | 752 | 435-453 | GCCCCAAGAUGAUGGAAGU | ACUUCCAUCAUCUUGGGGC |
| 753 | 754 | 437-455 | CCCAAGAUGAUGGAAGUUG | CAACUUCCAUCAUCUUGGG |
| 755 | 756 | 438-456 | CCAAGAUGAUGGAAGUUGG | CCAACUUCCAUCAUCUUGG |
| 757 | 758 | 439-457 | CAAGAUGAUGGAAGUUGGG | CCCAACUUCCAUCAUCUUG |

TABLE 9-continued

Human ALAS1 siRNA Sense and Antisense Sequences

| SEQ ID NO: (sense) | SEQ ID NO: (anti-sense) | Position on transcript NM_000688.4 | Sense Sequence (5'-3') | Antisense Sequence (5'-3') |
|---|---|---|---|---|
| 759 | 760 | 440-458 | AAGAUGAUGGAAGUUGGGG | CCCCAACUUCCAUCAUCUU |
| 761 | 762 | 441-459 | AGAUGAUGGAAGUUGGGGC | GCCCCAACUUCCAUCAUCU |
| 763 | 764 | 442-460 | GAUGAUGGAAGUUGGGGCC | GGCCCCAACUUCCAUCAUC |
| 765 | 766 | 443-461 | AUGAUGGAAGUUGGGGCCA | UGGCCCCAACUUCCAUCAU |
| 767 | 768 | 444-462 | UGAUGGAAGUUGGGGCCAA | UUGGCCCCAACUUCCAUCA |
| 769 | 770 | 445-463 | GAUGGAAGUUGGGGCCAAG | CUUGGCCCCAACUUCCAUC |
| 771 | 772 | 446-464 | AUGGAAGUUGGGGCCAAGC | GCUUGGCCCCAACUUCCAU |
| 773 | 774 | 447-465 | UGGAAGUUGGGGCCAAGCC | GGCUUGGCCCCAACUUCCA |
| 775 | 776 | 448-466 | GGAAGUUGGGGCCAAGCCA | UGGCUUGGCCCCAACUUCC |
| 777 | 778 | 449-467 | GAAGUUGGGGCCAAGCCAG | CUGGCUUGGCCCCAACUUC |
| 779 | 780 | 450-468 | AAGUUGGGGCCAAGCCAGC | GCUGGCUUGGCCCCAACUU |
| 781 | 782 | 451-469 | AGUUGGGGCCAAGCCAGCC | GGCUGGCUUGGCCCCAACU |
| 783 | 784 | 452-470 | GUUGGGGCCAAGCCAGCCC | GGGCUGGCUUGGCCCCAAC |
| 785 | 786 | 453-471 | UUGGGGCCAAGCCAGCCCC | GGGGCUGGCUUGGCCCCAA |
| 787 | 788 | 454-472 | UGGGGCCAAGCCAGCCCCU | AGGGGCUGGCUUGGCCCCA |
| 789 | 790 | 455-473 | GGGGCCAAGCCAGCCCCUC | GAGGGGCUGGCUUGGCCCC |
| 791 | 792 | 456-474 | GGGCCAAGCCAGCCCCUCG | CGAGGGGCUGGCUUGGCCC |
| 793 | 794 | 457-475 | GGCCAAGCCAGCCCCUCGG | CCGAGGGGCUGGCUUGGCC |
| 795 | 796 | 458-476 | GCCAAGCCAGCCCCUCGGG | CCCGAGGGGCUGGCUUGGC |
| 797 | 798 | 459-477 | CCAAGCCAGCCCCUCGGGC | GCCCGAGGGGCUGGCUUGG |
| 799 | 800 | 460-478 | CAAGCCAGCCCCUCGGGCA | UGCCCGAGGGGCUGGCUUG |
| 801 | 802 | 461-479 | AAGCCAGCCCCUCGGGCAU | AUGCCCGAGGGGCUGGCUU |
| 803 | 804 | 462-480 | AGCCAGCCCCUCGGGCAUU | AAUGCCCGAGGGGCUGGCU |
| 805 | 806 | 463-481 | GCCAGCCCCUCGGGCAUUG | CAAUGCCCGAGGGGCUGGC |
| 807 | 808 | 464-482 | CCAGCCCCUCGGGCAUUGU | ACAAUGCCCGAGGGGCUGG |
| 809 | 810 | 465-483 | CAGCCCCUCGGGCAUUGUC | GACAAUGCCCGAGGGGCUG |
| 811 | 812 | 466-484 | AGCCCCUCGGGCAUUGUCC | GGACAAUGCCCGAGGGGCU |
| 813 | 814 | 467-485 | GCCCCUCGGGCAUUGUCCA | UGGACAAUGCCCGAGGGGC |
| 815 | 816 | 468-486 | CCCCUCGGGCAUUGUCCAC | GUGGACAAUGCCCGAGGGG |
| 817 | 818 | 469-487 | CCCUCGGGCAUUGUCCACU | AGUGGACAAUGCCCGAGGG |
| 819 | 820 | 470-488 | CCUCGGGCAUUGUCCACUG | CAGUGGACAAUGCCCGAGG |
| 821 | 822 | 471-489 | CUCGGGCAUUGUCCACUGC | GCAGUGGACAAUGCCCGAG |
| 823 | 824 | 472-490 | UCGGGCAUUGUCCACUGCA | UGCAGUGGACAAUGCCCGA |
| 825 | 826 | 473-491 | CGGGCAUUGUCCACUGCAG | CUGCAGUGGACAAUGCCCG |
| 827 | 828 | 474-492 | GGGCAUUGUCCACUGCAGC | GCUGCAGUGGACAAUGCCC |
| 829 | 830 | 475-493 | GGCAUUGUCCACUGCAGCA | UGCUGCAGUGGACAAUGCC |

TABLE 9-continued

Human ALAS1 siRNA Sense and Antisense Sequences

| SEQ ID NO: (sense) | SEQ ID NO: (antisense) | Position on transcript NM_000688.4 | Sense Sequence (5'-3') | Antisense Sequence (5'-3') |
| --- | --- | --- | --- | --- |
| 831 | 832 | 476-494 | GCAUUGUCCACUGCAGCAG | CUGCUGCAGUGGACAAUGC |
| 833 | 834 | 477-495 | CAUUGUCCACUGCAGCAGU | ACUGCUGCAGUGGACAAUG |
| 835 | 836 | 478-496 | AUUGUCCACUGCAGCAGUA | UACUGCUGCAGUGGACAAU |
| 837 | 838 | 479-497 | UUGUCCACUGCAGCAGUAC | GUACUGCUGCAGUGGACAA |
| 839 | 840 | 480-498 | UGUCCACUGCAGCAGUACA | UGUACUGCUGCAGUGGACA |
| 841 | 842 | 481-499 | GUCCACUGCAGCAGUACAC | GUGUACUGCUGCAGUGGAC |
| 843 | 844 | 482-500 | UCCACUGCAGCAGUACACU | AGUGUACUGCUGCAGUGGA |
| 845 | 846 | 483-501 | CCACUGCAGCAGUACACUA | UAGUGUACUGCUGCAGUGG |
| 847 | 848 | 484-502 | CACUGCAGCAGUACACUAC | GUAGUGUACUGCUGCAGUG |
| 849 | 850 | 485-503 | ACUGCAGCAGUACACUACC | GGUAGUGUACUGCUGCAGU |
| 851 | 852 | 486-504 | CUGCAGCAGUACACUACCA | UGGUAGUGUACUGCUGCAG |
| 853 | 854 | 487-505 | UGCAGCAGUACACUACCAA | UUGGUAGUGUACUGCUGCA |
| 855 | 856 | 488-506 | GCAGCAGUACACUACCAAC | GUUGGUAGUGUACUGCUGC |
| 857 | 858 | 490-508 | AGCAGUACACUACCAACAG | CUGUUGGUAGUGUACUGCU |
| 859 | 860 | 491-509 | GCAGUACACUACCAACAGA | UCUGUUGGUAGUGUACUGC |
| 861 | 862 | 492-510 | CAGUACACUACCAACAGAU | AUCUGUUGGUAGUGUACUG |
| 863 | 864 | 493-511 | AGUACACUACCAACAGAUC | GAUCUGUUGGUAGUGUACU |
| 865 | 866 | 494-512 | GUACACUACCAACAGAUCA | UGAUCUGUUGGUAGUGUAC |
| 867 | 868 | 495-513 | UACACUACCAACAGAUCAA | UUGAUCUGUUGGUAGUGUA |
| 869 | 870 | 496-514 | ACACUACCAACAGAUCAAA | UUUGAUCUGUUGGUAGUGU |
| 871 | 872 | 497-515 | CACUACCAACAGAUCAAAG | CUUUGAUCUGUUGGUAGUG |
| 873 | 874 | 498-516 | ACUACCAACAGAUCAAAGA | UCUUUGAUCUGUUGGUAGU |
| 875 | 876 | 499-517 | CUACCAACAGAUCAAAGAA | UUCUUUGAUCUGUUGGUAG |
| 877 | 878 | 500-518 | UACCAACAGAUCAAAGAAA | UUUCUUUGAUCUGUUGGUA |
| 879 | 880 | 501-519 | ACCAACAGAUCAAAGAAAC | GUUUCUUUGAUCUGUUGGU |
| 881 | 882 | 502-520 | CCAACAGAUCAAAGAAACC | GGUUUCUUUGAUCUGUUGG |
| 883 | 884 | 523-541 | UCCGGCCAGUGAGAAAGAC | GUCUUUCUCACUGGCCGGA |
| 885 | 886 | 524-542 | CCGGCCAGUGAGAAAGACA | UGUCUUUCUCACUGGCCGG |
| 887 | 888 | 525-543 | CGGCCAGUGAGAAAGACAA | UUGUCUUUCUCACUGGCCG |
| 889 | 890 | 526-544 | GGCCAGUGAGAAAGACAAA | UUUGUCUUUCUCACUGGCC |
| 891 | 892 | 527-545 | GCCAGUGAGAAAGACAAAA | UUUUGUCUUUCUCACUGGC |
| 893 | 894 | 528-546 | CCAGUGAGAAAGACAAAAC | GUUUUGUCUUUCUCACUGG |
| 895 | 896 | 529-547 | CAGUGAGAAAGACAAAACU | AGUUUUGUCUUUCUCACUG |
| 897 | 898 | 530-548 | AGUGAGAAAGACAAAACUG | CAGUUUUGUCUUUCUCACU |
| 899 | 900 | 531-549 | GUGAGAAAGACAAAACUGC | GCAGUUUUGUCUUUCUCAC |
| 901 | 902 | 570-588 | CUCCUGAUGGAUCCCAGCA | UGCUGGGAUCCAUCAGGAG |

TABLE 9-continued

Human ALAS1 siRNA Sense and Antisense Sequences

| SEQ ID NO: (sense) | SEQ ID NO: (antisense) | Position on transcript NM_000688.4 | Sense Sequence (5'-3') | Antisense Sequence (5'-3') |
|---|---|---|---|---|
| 903 | 904 | 571-589 | UCCUGAUGGAUCCCAGCAG | CUGCUGGGAUCCAUCAGGA |
| 905 | 906 | 572-590 | CCUGAUGGAUCCCAGCAGA | UCUGCUGGGAUCCAUCAGG |
| 907 | 908 | 573-591 | CUGAUGGAUCCCAGCAGAG | CUCUGCUGGGAUCCAUCAG |
| 909 | 910 | 574-592 | UGAUGGAUCCCAGCAGAGU | ACUCUGCUGGGAUCCAUCA |
| 911 | 912 | 575-593 | GAUGGAUCCCAGCAGAGUC | GACUCUGCUGGGAUCCAUC |
| 913 | 914 | 576-594 | AUGGAUCCCAGCAGAGUCC | GGACUCUGCUGGGAUCCAU |
| 915 | 916 | 577-595 | UGGAUCCCAGCAGAGUCCA | UGGACUCUGCUGGGAUCCA |
| 917 | 918 | 578-596 | GGAUCCCAGCAGAGUCCAG | CUGGACUCUGCUGGGAUCC |
| 919 | 920 | 579-597 | GAUCCCAGCAGAGUCCAGA | UCUGGACUCUGCUGGGAUC |
| 921 | 922 | 580-598 | AUCCCAGCAGAGUCCAGAU | AUCUGGACUCUGCUGGGAU |
| 923 | 924 | 581-599 | UCCCAGCAGAGUCCAGAUG | CAUCUGGACUCUGCUGGGA |
| 925 | 926 | 582-600 | CCCAGCAGAGUCCAGAUGG | CCAUCUGGACUCUGCUGGG |
| 927 | 928 | 583-601 | CCAGCAGAGUCCAGAUGGC | GCCAUCUGGACUCUGCUGG |
| 929 | 930 | 584-602 | CAGCAGAGUCCAGAUGGCA | UGCCAUCUGGACUCUGCUG |
| 931 | 932 | 585-603 | AGCAGAGUCCAGAUGGCAC | GUGCCAUCUGGACUCUGCU |
| 933 | 934 | 586-604 | GCAGAGUCCAGAUGGCACA | UGUGCCAUCUGGACUCUGC |
| 935 | 936 | 587-605 | CAGAGUCCAGAUGGCACAC | GUGUGCCAUCUGGACUCUG |
| 937 | 938 | 588-606 | AGAGUCCAGAUGGCACACA | UGUGUGCCAUCUGGACUCU |
| 939 | 940 | 589-607 | GAGUCCAGAUGGCACACAG | CUGUGUGCCAUCUGGACUC |
| 941 | 942 | 590-608 | AGUCCAGAUGGCACACAGC | GCUGUGUGCCAUCUGGACU |
| 943 | 944 | 591-609 | GUCCAGAUGGCACACAGCU | AGCUGUGUGCCAUCUGGAC |
| 945 | 946 | 592-610 | UCCAGAUGGCACACAGCUU | AAGCUGUGUGCCAUCUGGA |
| 947 | 948 | 593-611 | CCAGAUGGCACACAGCUUC | GAAGCUGUGUGCCAUCUGG |
| 949 | 950 | 594-612 | CAGAUGGCACACAGCUUCC | GGAAGCUGUGUGCCAUCUG |
| 951 | 952 | 595-613 | AGAUGGCACACAGCUUCCG | CGGAAGCUGUGUGCCAUCU |
| 953 | 954 | 596-614 | GAUGGCACACAGCUUCCGU | ACGGAAGCUGUGUGCCAUC |
| 955 | 956 | 597-615 | AUGGCACACAGCUUCCGUC | GACGGAAGCUGUGUGCCAU |
| 957 | 958 | 598-616 | UGGCACACAGCUUCCGUCU | AGACGGAAGCUGUGUGCCA |
| 959 | 960 | 599-617 | GGCACACAGCUUCCGUCUG | CAGACGGAAGCUGUGUGCC |
| 961 | 962 | 600-618 | GCACACAGCUUCCGUCUGG | CCAGACGGAAGCUGUGUGC |
| 963 | 964 | 601-619 | CACACAGCUUCCGUCUGGA | UCCAGACGGAAGCUGUGUG |
| 965 | 966 | 602-620 | ACACAGCUUCCGUCUGGAC | GUCCAGACGGAAGCUGUGU |
| 967 | 968 | 603-621 | CACAGCUUCCGUCUGGACA | UGUCCAGACGGAAGCUGUG |
| 969 | 970 | 604-622 | ACAGCUUCCGUCUGGACAC | GUGUCCAGACGGAAGCUGU |
| 971 | 972 | 605-623 | CAGCUUCCGUCUGGACACC | GGUGUCCAGACGGAAGCUG |
| 973 | 974 | 606-624 | AGCUUCCGUCUGGACACCC | GGGUGUCCAGACGGAAGCU |

TABLE 9-continued

Human ALAS1 siRNA Sense and Antisense Sequences

| SEQ ID NO: (sense) | SEQ ID NO: (anti-sense) | Position on transcript NM_000688.4 | Sense Sequence (5'-3') | Antisense Sequence (5'-3') |
|---|---|---|---|---|
| 975 | 976 | 607-625 | GCUUCCGUCUGGACACCCC | GGGGUGUCCAGACGGAAGC |
| 977 | 978 | 608-626 | CUUCCGUCUGGACACCCCU | AGGGGUGUCCAGACGGAAG |
| 979 | 980 | 609-627 | UUCCGUCUGGACACCCCUU | AAGGGGUGUCCAGACGGAA |
| 981 | 982 | 610-628 | UCCGUCUGGACACCCCUUG | CAAGGGGUGUCCAGACGGA |
| 983 | 984 | 611-629 | CCGUCUGGACACCCCUUGC | GCAAGGGGUGUCCAGACGG |
| 985 | 986 | 612-630 | CGUCUGGACACCCCUUGCC | GGCAAGGGGUGUCCAGACG |
| 987 | 988 | 613-631 | GUCUGGACACCCCUUGCCU | AGGCAAGGGGUGUCCAGAC |
| 989 | 990 | 614-632 | UCUGGACACCCCUUGCCUG | CAGGCAAGGGGUGUCCAGA |
| 991 | 992 | 615-633 | CUGGACACCCCUUGCCUGC | GCAGGCAAGGGGUGUCCAG |
| 993 | 994 | 616-634 | UGGACACCCCUUGCCUGCC | GGCAGGCAAGGGGUGUCCA |
| 995 | 996 | 617-635 | GGACACCCCUUGCCUGCCA | UGGCAGGCAAGGGGUGUCC |
| 997 | 998 | 618-636 | GACACCCCUUGCCUGCCAC | GUGGCAGGCAAGGGGUGUC |
| 999 | 1000 | 619-637 | ACACCCCUUGCCUGCCACA | UGUGGCAGGCAAGGGGUGU |
| 1001 | 1002 | 620-638 | CACCCCUUGCCUGCCACAA | UUGUGGCAGGCAAGGGGUG |
| 1003 | 1004 | 621-639 | ACCCCUUGCCUGCCACAAG | CUUGUGGCAGGCAAGGGGU |
| 1005 | 1006 | 622-640 | CCCCUUGCCUGCCACAAGC | GCUUGUGGCAGGCAAGGGG |
| 1007 | 1008 | 623-641 | CCCUUGCCUGCCACAAGCC | GGCUUGUGGCAGGCAAGGG |
| 1009 | 1010 | 624-642 | CCUUGCCUGCCACAAGCCA | UGGCUUGUGGCAGGCAAGG |
| 1011 | 1012 | 625-643 | CUUGCCUGCCACAAGCCAG | CUGGCUUGUGGCAGGCAAG |
| 1013 | 1014 | 626-644 | UUGCCUGCCACAAGCCAGG | CCUGGCUUGUGGCAGGCAA |
| 1015 | 1016 | 627-645 | UGCCUGCCACAAGCCAGGG | CCCUGGCUUGUGGCAGGCA |
| 1017 | 1018 | 628-646 | GCCUGCCACAAGCCAGGGC | GCCCUGGCUUGUGGCAGGC |
| 1019 | 1020 | 629-647 | CCUGCCACAAGCCAGGGCA | UGCCCUGGCUUGUGGCAGG |
| 1021 | 1022 | 630-648 | CUGCCACAAGCCAGGGCAC | GUGCCCUGGCUUGUGGCAG |
| 1023 | 1024 | 631-649 | UGCCACAAGCCAGGGCACU | AGUGCCCUGGCUUGUGGCA |
| 1025 | 1026 | 632-650 | GCCACAAGCCAGGGCACUG | CAGUGCCCUGGCUUGUGGC |
| 1027 | 1028 | 633-651 | CCACAAGCCAGGGCACUGC | GCAGUGCCCUGGCUUGUGG |
| 1029 | 1030 | 634-652 | CACAAGCCAGGGCACUGCA | UGCAGUGCCCUGGCUUGUG |
| 1031 | 1032 | 635-653 | ACAAGCCAGGGCACUGCAA | UUGCAGUGCCCUGGCUUGU |
| 1033 | 1034 | 636-654 | CAAGCCAGGGCACUGCAAG | CUUGCAGUGCCCUGGCUUG |
| 1035 | 1036 | 637-655 | AAGCCAGGGCACUGCAAGC | GCUUGCAGUGCCCUGGCUU |
| 1037 | 1038 | 638-656 | AGCCAGGGCACUGCAAGCA | UGCUUGCAGUGCCCUGGCU |
| 1039 | 1040 | 639-657 | GCCAGGGCACUGCAAGCAA | UUGCUUGCAGUGCCCUGGC |
| 1041 | 1042 | 640-658 | CCAGGGCACUGCAAGCAAA | UUUGCUUGCAGUGCCCUGG |
| 1043 | 1044 | 641-659 | CAGGGCACUGCAAGCAAAU | AUUUGCUUGCAGUGCCCUG |
| 1045 | 1046 | 642-660 | AGGGCACUGCAAGCAAAUG | CAUUUGCUUGCAGUGCCCU |

TABLE 9-continued

Human ALAS1 siRNA Sense and Antisense Sequences

| SEQ ID NO: (sense) | SEQ ID NO: (anti-sense) | Position on transcript NM_000688.4 | Sense Sequence (5'-3') | Antisense Sequence (5'-3') |
|---|---|---|---|---|
| 1047 | 1048 | 643-661 | GGGCACUGCAAGCAAAUGC | GCAUUUGCUUGCAGUGCCC |
| 1049 | 1050 | 644-662 | GGCACUGCAAGCAAAUGCC | GGCAUUUGCUUGCAGUGCC |
| 1051 | 1052 | 645-663 | GCACUGCAAGCAAAUGCCC | GGGCAUUUGCUUGCAGUGC |
| 1053 | 1054 | 647-665 | ACUGCAAGCAAAUGCCCUU | AAGGGCAUUUGCUUGCAGU |
| 1055 | 1056 | 648-666 | CUGCAAGCAAAUGCCCUUU | AAAGGGCAUUUGCUUGCAG |
| 1057 | 1058 | 649-667 | UGCAAGCAAAUGCCCUUUC | GAAAGGGCAUUUGCUUGCA |
| 1059 | 1060 | 650-668 | GCAAGCAAAUGCCCUUUCC | GGAAAGGGCAUUUGCUUGC |
| 1061 | 1062 | 651-669 | CAAGCAAAUGCCCUUUCCU | AGGAAAGGGCAUUUGCUUG |
| 1063 | 1064 | 652-670 | AAGCAAAUGCCCUUUCCUG | CAGGAAAGGGCAUUUGCUU |
| 1065 | 1066 | 653-671 | AGCAAAUGCCCUUUCCUGG | CCAGGAAAGGGCAUUUGCU |
| 1067 | 1068 | 654-672 | GCAAAUGCCCUUUCCUGGC | GCCAGGAAAGGGCAUUUGC |
| 1069 | 1070 | 655-673 | CAAAUGCCCUUUCCUGGCA | UGCCAGGAAAGGGCAUUUG |
| 1071 | 1072 | 656-674 | AAAUGCCCUUUCCUGGCAG | CUGCCAGGAAAGGGCAUUU |
| 1073 | 1074 | 657-675 | AAUGCCCUUUCCUGGCAGC | GCUGCCAGGAAAGGGCAUU |
| 1075 | 1076 | 658-676 | AUGCCCUUUCCUGGCAGCA | UGCUGCCAGGAAAGGGCAU |
| 1077 | 1078 | 659-677 | UGCCCUUUCCUGGCAGCAC | GUGCUGCCAGGAAAGGGCA |
| 1079 | 1080 | 660-678 | GCCCUUUCCUGGCAGCACA | UGUGCUGCCAGGAAAGGGC |
| 1081 | 1082 | 661-679 | CCCUUUCCUGGCAGCACAG | CUGUGCUGCCAGGAAAGGG |
| 1083 | 1084 | 662-680 | CCUUUCCUGGCAGCACAGA | UCUGUGCUGCCAGGAAAGG |
| 1085 | 1086 | 663-681 | CUUUCCUGGCAGCACAGAU | AUCUGUGCUGCCAGGAAAG |
| 1087 | 1088 | 664-682 | UUUCCUGGCAGCACAGAUG | CAUCUGUGCUGCCAGGAAA |
| 1089 | 1090 | 665-683 | UUCCUGGCAGCACAGAUGA | UCAUCUGUGCUGCCAGGAA |
| 1091 | 1092 | 666-684 | UCCUGGCAGCACAGAUGAA | UUCAUCUGUGCUGCCAGGA |
| 1093 | 1094 | 667-685 | CCUGGCAGCACAGAUGAAU | AUUCAUCUGUGCUGCCAGG |
| 1095 | 1096 | 668-686 | CUGGCAGCACAGAUGAAUC | GAUUCAUCUGUGCUGCCAG |
| 1097 | 1098 | 670-688 | GGCAGCACAGAUGAAUCAG | CUGAUUCAUCUGUGCUGCC |
| 1099 | 1100 | 672-690 | CAGCACAGAUGAAUCAGAG | CUCUGAUUCAUCUGUGCUG |
| 1101 | 1102 | 692-710 | GGCAGCAGUGUCUUCUGCA | UGCAGAAGACACUGCUGCC |
| 1103 | 1104 | 693-711 | GCAGCAGUGUCUUCUGCAA | UUGCAGAAGACACUGCUGC |
| 1105 | 1106 | 694-712 | CAGCAGUGUCUUCUGCAAA | UUUGCAGAAGACACUGCUG |
| 1107 | 1108 | 695-713 | AGCAGUGUCUUCUGCAAAG | CUUUGCAGAAGACACUGCU |
| 1109 | 1110 | 696-714 | GCAGUGUCUUCUGCAAAGC | GCUUUGCAGAAGACACUGC |
| 1111 | 1112 | 697-715 | CAGUGUCUUCUGCAAAGCC | GGCUUUGCAGAAGACACUG |
| 1113 | 1114 | 698-716 | AGUGUCUUCUGCAAAGCCA | UGGCUUUGCAGAAGACACU |
| 1115 | 1116 | 699-717 | GUGUCUUCUGCAAAGCCAG | CUGGCUUUGCAGAAGACAC |
| 1117 | 1118 | 700-718 | UGUCUUCUGCAAAGCCAGU | ACUGGCUUUGCAGAAGACA |

TABLE 9-continued

Human ALAS1 siRNA Sense and Antisense Sequences

| SEQ ID NO: (sense) | SEQ ID NO: (anti-sense) | Position on transcript NM_000688.4 | Sense Sequence (5'-3') | Antisense Sequence (5'-3') |
|---|---|---|---|---|
| 1119 | 1120 | 701-719 | GUCUUCUGCAAAGCCAGUC | GACUGGCUUUGCAGAAGAC |
| 1121 | 1122 | 702-720 | UCUUCUGCAAAGCCAGUCU | AGACUGGCUUUGCAGAAGA |
| 1123 | 1124 | 703-721 | CUUCUGCAAAGCCAGUCUU | AAGACUGGCUUUGCAGAAG |
| 1125 | 1126 | 704-722 | UUCUGCAAAGCCAGUCUUG | CAAGACUGGCUUUGCAGAA |
| 1127 | 1128 | 705-723 | UCUGCAAAGCCAGUCUUGA | UCAAGACUGGCUUUGCAGA |
| 1129 | 1130 | 706-724 | CUGCAAAGCCAGUCUUGAG | CUCAAGACUGGCUUUGCAG |
| 1131 | 1132 | 707-725 | UGCAAAGCCAGUCUUGAGC | GCUCAAGACUGGCUUUGCA |
| 1133 | 1134 | 708-726 | GCAAAGCCAGUCUUGAGCU | AGCUCAAGACUGGCUUUGC |
| 1135 | 1136 | 709-727 | CAAAGCCAGUCUUGAGCUU | AAGCUCAAGACUGGCUUUG |
| 1137 | 1138 | 710-728 | AAAGCCAGUCUUGAGCUUC | GAAGCUCAAGACUGGCUUU |
| 1139 | 1140 | 711-729 | AAGCCAGUCUUGAGCUUCA | UGAAGCUCAAGACUGGCUU |
| 1141 | 1142 | 712-730 | AGCCAGUCUUGAGCUUCAG | CUGAAGCUCAAGACUGGCU |
| 1143 | 1144 | 713-731 | GCCAGUCUUGAGCUUCAGG | CCUGAAGCUCAAGACUGGC |
| 1145 | 1146 | 714-732 | CCAGUCUUGAGCUUCAGGA | UCCUGAAGCUCAAGACUGG |
| 1147 | 1148 | 715-733 | CAGUCUUGAGCUUCAGGAG | CUCCUGAAGCUCAAGACUG |
| 1149 | 1150 | 716-734 | AGUCUUGAGCUUCAGGAGG | CCUCCUGAAGCUCAAGACU |
| 1151 | 1152 | 717-735 | GUCUUGAGCUUCAGGAGGA | UCCUCCUGAAGCUCAAGAC |
| 1153 | 1154 | 718-736 | UCUUGAGCUUCAGGAGGAU | AUCCUCCUGAAGCUCAAGA |
| 1155 | 1156 | 719-737 | CUUGAGCUUCAGGAGGAUG | CAUCCUCCUGAAGCUCAAG |
| 1157 | 1158 | 720-738 | UUGAGCUUCAGGAGGAUGU | ACAUCCUCCUGAAGCUCAA |
| 1159 | 1160 | 721-739 | UGAGCUUCAGGAGGAUGUG | CACAUCCUCCUGAAGCUCA |
| 1161 | 1162 | 722-740 | GAGCUUCAGGAGGAUGUGC | GCACAUCCUCCUGAAGCUC |
| 1163 | 1164 | 723-741 | AGCUUCAGGAGGAUGUGCA | UGCACAUCCUCCUGAAGCU |
| 1165 | 1166 | 724-742 | GCUUCAGGAGGAUGUGCAG | CUGCACAUCCUCCUGAAGC |
| 1167 | 1168 | 725-743 | CUUCAGGAGGAUGUGCAGG | CCUGCACAUCCUCCUGAAG |
| 1169 | 1170 | 726-744 | UUCAGGAGGAUGUGCAGGA | UCCUGCACAUCCUCCUGAA |
| 1171 | 1172 | 727-745 | UCAGGAGGAUGUGCAGGAA | UUCCUGCACAUCCUCCUGA |
| 1173 | 1174 | 728-746 | CAGGAGGAUGUGCAGGAAA | UUUCCUGCACAUCCUCCUG |
| 1175 | 1176 | 729-747 | AGGAGGAUGUGCAGGAAAU | AUUUCCUGCACAUCCUCCU |
| 1177 | 1178 | 730-748 | GGAGGAUGUGCAGGAAAUG | CAUUUCCUGCACAUCCUCC |
| 1179 | 1180 | 731-749 | GAGGAUGUGCAGGAAAUGA | UCAUUUCCUGCACAUCCUC |
| 1181 | 1182 | 732-750 | AGGAUGUGCAGGAAAUGAA | UUCAUUUCCUGCACAUCCU |
| 1183 | 1184 | 733-751 | GGAUGUGCAGGAAAUGAAU | AUUCAUUUCCUGCACAUCC |
| 1185 | 1186 | 734-752 | GAUGUGCAGGAAAUGAAUG | CAUUCAUUUCCUGCACAUC |
| 1187 | 1188 | 735-753 | AUGUGCAGGAAAUGAAUGC | GCAUUCAUUUCCUGCACAU |
| 1189 | 1190 | 755-773 | GUGAGGAAAGAGGUUGCUG | CAGCAACCUCUUUCCUCAC |

TABLE 9-continued

Human ALAS1 siRNA Sense and Antisense Sequences

| SEQ ID NO: (sense) | SEQ ID NO: (antisense) | Position on transcript NM_000688.4 | Sense Sequence (5'-3') | Antisense Sequence (5'-3') |
|---|---|---|---|---|
| 1191 | 1192 | 756-774 | UGAGGAAAGAGGUUGCUGA | UCAGCAACCUCUUUCCUCA |
| 1193 | 1194 | 757-775 | GAGGAAAGAGGUUGCUGAA | UUCAGCAACCUCUUUCCUC |
| 1195 | 1196 | 758-776 | AGGAAAGAGGUUGCUGAAA | UUUCAGCAACCUCUUUCCU |
| 1197 | 1198 | 759-777 | GGAAAGAGGUUGCUGAAAC | GUUUCAGCAACCUCUUUCC |
| 1199 | 1200 | 760-778 | GAAAGAGGUUGCUGAAACC | GGUUUCAGCAACCUCUUUC |
| 1201 | 1202 | 761-779 | AAAGAGGUUGCUGAAACCU | AGGUUUCAGCAACCUCUUU |
| 1203 | 1204 | 762-780 | AAGAGGUUGCUGAAACCUC | GAGGUUUCAGCAACCUCUU |
| 1205 | 1206 | 763-781 | AGAGGUUGCUGAAACCUCA | UGAGGUUUCAGCAACCUCU |
| 1207 | 1208 | 764-782 | GAGGUUGCUGAAACCUCAG | CUGAGGUUUCAGCAACCUC |
| 1209 | 1210 | 765-783 | AGGUUGCUGAAACCUCAGC | GCUGAGGUUUCAGCAACCU |
| 1211 | 1212 | 766-784 | GGUUGCUGAAACCUCAGCA | UGCUGAGGUUUCAGCAACC |
| 1213 | 1214 | 787-805 | CCCCAGUGUGGUUAGUGUG | CACACUAACCACACUGGGG |
| 1215 | 1216 | 791-809 | AGUGUGGUUAGUGUGAAAA | UUUUCACACUAACCACACU |
| 1217 | 1218 | 792-810 | GUGUGGUUAGUGUGAAAAC | GUUUUCACACUAACCACAC |
| 1219 | 1220 | 812-830 | GAUGGAGGGGAUCCCAGUG | CACUGGGAUCCCCUCCAUC |
| 1221 | 1222 | 813-831 | AUGGAGGGGAUCCCAGUGG | CCACUGGGAUCCCCUCCAU |
| 1223 | 1224 | 833-851 | CUGCUGAAGAACUUCCAGG | CCUGGAAGUUCUUCAGCAG |
| 1225 | 1226 | 834-852 | UGCUGAAGAACUUCCAGGA | UCCUGGAAGUUCUUCAGCA |
| 1227 | 1228 | 835-853 | GCUGAAGAACUUCCAGGAC | GUCCUGGAAGUUCUUCAGC |
| 1229 | 1230 | 836-854 | CUGAAGAACUUCCAGGACA | UGUCCUGGAAGUUCUUCAG |
| 1231 | 1232 | 837-855 | UGAAGAACUUCCAGGACAU | AUGUCCUGGAAGUUCUUCA |
| 1233 | 1234 | 838-856 | GAAGAACUUCCAGGACAUC | GAUGUCCUGGAAGUUCUUC |
| 1235 | 1236 | 839-857 | AAGAACUUCCAGGACAUCA | UGAUGUCCUGGAAGUUCUU |
| 1237 | 1238 | 840-858 | AGAACUUCCAGGACAUCAU | AUGAUGUCCUGGAAGUUCU |
| 1239 | 1240 | 841-859 | GAACUUCCAGGACAUCAUG | CAUGAUGUCCUGGAAGUUC |
| 1241 | 1242 | 842-860 | AACUUCCAGGACAUCAUGC | GCAUGAUGUCCUGGAAGUU |
| 1243 | 1244 | 843-861 | ACUUCCAGGACAUCAUGCA | UGCAUGAUGUCCUGGAAGU |
| 1245 | 1246 | 844-862 | CUUCCAGGACAUCAUGCAA | UUGCAUGAUGUCCUGGAAG |
| 1247 | 1248 | 845-863 | UUCCAGGACAUCAUGCAAA | UUUGCAUGAUGUCCUGGAA |
| 1249 | 1250 | 846-864 | UCCAGGACAUCAUGCAAAA | UUUUGCAUGAUGUCCUGGA |
| 1251 | 1252 | 847-865 | CCAGGACAUCAUGCAAAAG | CUUUUGCAUGAUGUCCUGG |
| 1253 | 1254 | 848-866 | CAGGACAUCAUGCAAAAGC | GCUUUUGCAUGAUGUCCUG |
| 1255 | 1256 | 849-867 | AGGACAUCAUGCAAAAGCA | UGCUUUUGCAUGAUGUCCU |
| 1257 | 1258 | 850-868 | GGACAUCAUGCAAAAGCAA | UUGCUUUUGCAUGAUGUCC |
| 1259 | 1260 | 851-869 | GACAUCAUGCAAAAGCAAA | UUUGCUUUUGCAUGAUGUC |
| 1261 | 1262 | 852-870 | ACAUCAUGCAAAAGCAAAG | CUUUGCUUUUGCAUGAUGU |

TABLE 9-continued

Human ALAS1 siRNA Sense and Antisense Sequences

| SEQ ID NO: (sense) | SEQ ID NO: (antisense) | Position on transcript NM_000688.4 | Sense Sequence (5'-3') | Antisense Sequence (5'-3') |
|---|---|---|---|---|
| 1263 | 1264 | 854-872 | AUCAUGCAAAAGCAAAGAC | GUCUUUGCUUUUGCAUGAU |
| 1265 | 1266 | 855-873 | UCAUGCAAAAGCAAAGACC | GGUCUUUGCUUUUGCAUGA |
| 1267 | 1268 | 856-874 | CAUGCAAAAGCAAAGACCA | UGGUCUUUGCUUUUGCAUG |
| 1269 | 1270 | 857-875 | AUGCAAAAGCAAAGACCAG | CUGGUCUUUGCUUUUGCAU |
| 1271 | 1272 | 858-876 | UGCAAAAGCAAAGACCAGA | UCUGGUCUUUGCUUUUGCA |
| 1273 | 1274 | 859-877 | GCAAAAGCAAAGACCAGAA | UUCUGGUCUUUGCUUUUGC |
| 1275 | 1276 | 860-878 | CAAAAGCAAAGACCAGAAA | UUUCUGGUCUUUGCUUUUG |
| 1277 | 1278 | 861-879 | AAAAGCAAAGACCAGAAAG | CUUUCUGGUCUUUGCUUUU |
| 1279 | 1280 | 862-880 | AAAGCAAAGACCAGAAAGA | UCUUUCUGGUCUUUGCUUU |
| 1281 | 1282 | 863-881 | AAGCAAAGACCAGAAAGAG | CUCUUUCUGGUCUUUGCUU |
| 1283 | 1284 | 864-882 | AGCAAAGACCAGAAAGAGU | ACUCUUUCUGGUCUUUGCU |
| 1285 | 1286 | 865-883 | GCAAAGACCAGAAAGAGUG | CACUCUUUCUGGUCUUUGC |
| 1287 | 1288 | 867-885 | AAAGACCAGAAAGAGUGUC | GACACUCUUUCUGGUCUUU |
| 1289 | 1290 | 868-886 | AAGACCAGAAAGAGUGUCU | AGACACUCUUUCUGGUCUU |
| 1291 | 1292 | 869-887 | AGACCAGAAAGAGUGUCUC | GAGACACUCUUUCUGGUCU |
| 1293 | 1294 | 870-888 | GACCAGAAAGAGUGUCUCA | UGAGACACUCUUUCUGGUC |
| 1295 | 1296 | 871-889 | ACCAGAAAGAGUGUCUCAU | AUGAGACACUCUUUCUGGU |
| 1297 | 1298 | 872-890 | CCAGAAAGAGUGUCUCAUC | GAUGAGACACUCUUUCUGG |
| 1299 | 1300 | 875-893 | GAAAGAGUGUCUCAUCUUC | GAAGAUGAGACACUCUUUC |
| 1301 | 1302 | 878-896 | AGAGUGUCUCAUCUUCUUC | GAAGAAGAUGAGACACUCU |
| 1303 | 1304 | 879-897 | GAGUGUCUCAUCUUCUUCA | UGAAGAAGAUGAGACACUC |
| 1305 | 1306 | 880-898 | AGUGUCUCAUCUUCUUCAA | UUGAAGAAGAUGAGACACU |
| 1307 | 1308 | 881-899 | GUGUCUCAUCUUCUUCAAG | CUUGAAGAAGAUGAGACAC |
| 1309 | 1310 | 882-900 | UGUCUCAUCUUCUUCAAGA | UCUUGAAGAAGAUGAGACA |
| 1311 | 1312 | 883-901 | GUCUCAUCUUCUUCAAGAU | AUCUUGAAGAAGAUGAGAC |
| 1313 | 1314 | 884-902 | UCUCAUCUUCUUCAAGAUA | UAUCUUGAAGAAGAUGAGA |
| 1315 | 1316 | 886-904 | UCAUCUUCUUCAAGAUAAC | GUUAUCUUGAAGAAGAUGA |
| 1317 | 1318 | 887-905 | CAUCUUCUUCAAGAUAACU | AGUUAUCUUGAAGAAGAUG |
| 1319 | 1320 | 888-906 | AUCUUCUUCAAGAUAACUU | AAGUUAUCUUGAAGAAGAU |
| 1321 | 1322 | 889-907 | UCUUCUUCAAGAUAACUUG | CAAGUUAUCUUGAAGAAGA |
| 1323 | 1324 | 890-908 | CUUCUUCAAGAUAACUUGC | GCAAGUUAUCUUGAAGAAG |
| 1325 | 1326 | 891-909 | UUCUUCAAGAUAACUUGCC | GGCAAGUUAUCUUGAAGAA |
| 1327 | 1328 | 892-910 | UCUUCAAGAUAACUUGCCA | UGGCAAGUUAUCUUGAAGA |
| 1329 | 1330 | 893-911 | CUUCAAGAUAACUUGCCAA | UUGGCAAGUUAUCUUGAAG |
| 1331 | 1332 | 894-912 | UUCAAGAUAACUUGCCAAA | UUUGGCAAGUUAUCUUGAA |
| 1333 | 1334 | 895-913 | UCAAGAUAACUUGCCAAAA | UUUUGGCAAGUUAUCUUGA |

TABLE 9-continued

Human ALAS1 siRNA Sense and Antisense Sequences

| SEQ ID NO: (sense) | SEQ ID NO: (anti-sense) | Position on transcript NM_000688.4 | Sense Sequence (5'-3') | Antisense Sequence (5'-3') |
|---|---|---|---|---|
| 1335 | 1336 | 896-914 | CAAGAUAACUUGCCAAAAU | AUUUUGGCAAGUUAUCUUG |
| 1337 | 1338 | 897-915 | AAGAUAACUUGCCAAAAUC | GAUUUUGGCAAGUUAUCUU |
| 1339 | 1340 | 898-916 | AGAUAACUUGCCAAAAUCU | AGAUUUUGGCAAGUUAUCU |
| 1341 | 1342 | 899-917 | GAUAACUUGCCAAAAUCUG | CAGAUUUUGGCAAGUUAUC |
| 1343 | 1344 | 900-918 | AUAACUUGCCAAAAUCUGU | ACAGAUUUUGGCAAGUUAU |
| 1345 | 1346 | 901-919 | UAACUUGCCAAAAUCUGUU | AACAGAUUUUGGCAAGUUA |
| 1347 | 1348 | 902-920 | AACUUGCCAAAAUCUGUUU | AAACAGAUUUUGGCAAGUU |
| 1349 | 1350 | 903-921 | ACUUGCCAAAAUCUGUUUC | GAAACAGAUUUUGGCAAGU |
| 1351 | 1352 | 904-922 | CUUGCCAAAAUCUGUUUCC | GGAAACAGAUUUUGGCAAG |
| 1353 | 1354 | 905-923 | UUGCCAAAAUCUGUUUCCA | UGGAAACAGAUUUUGGCAA |
| 1355 | 1356 | 906-924 | UGCCAAAAUCUGUUUCCAC | GUGGAAACAGAUUUUGGCA |
| 1357 | 1358 | 907-925 | GCCAAAAUCUGUUUCCACU | AGUGGAAACAGAUUUUGGC |
| 1359 | 1360 | 908-926 | CCAAAAUCUGUUUCCACUU | AAGUGGAAACAGAUUUUGG |
| 1361 | 1362 | 909-927 | CAAAAUCUGUUUCCACUUU | AAAGUGGAAACAGAUUUUG |
| 1363 | 1364 | 910-928 | AAAAUCUGUUUCCACUUUU | AAAAGUGGAAACAGAUUUU |
| 1365 | 1366 | 911-929 | AAAUCUGUUUCCACUUUUC | GAAAAGUGGAAACAGAUUU |
| 1367 | 1368 | 912-930 | AAUCUGUUUCCACUUUUCA | UGAAAAGUGGAAACAGAUU |
| 1369 | 1370 | 913-931 | AUCUGUUUCCACUUUUCAG | CUGAAAAGUGGAAACAGAU |
| 1371 | 1372 | 916-934 | UGUUUCCACUUUUCAGUAU | AUACUGAAAAGUGGAAACA |
| 1373 | 1374 | 917-935 | GUUUCCACUUUUCAGUAUG | CAUACUGAAAAGUGGAAAC |
| 1375 | 1376 | 918-936 | UUUCCACUUUUCAGUAUGA | UCAUACUGAAAAGUGGAAA |
| 1377 | 1378 | 919-937 | UUCCACUUUUCAGUAUGAU | AUCAUACUGAAAAGUGGAA |
| 1379 | 1380 | 920-938 | UCCACUUUUCAGUAUGAUC | GAUCAUACUGAAAAGUGGA |
| 1381 | 1382 | 921-939 | CCACUUUUCAGUAUGAUCG | CGAUCAUACUGAAAAGUGG |
| 1383 | 1384 | 925-943 | UUUUCAGUAUGAUCGUUUC | GAAACGAUCAUACUGAAAA |
| 1385 | 1386 | 929-947 | CAGUAUGAUCGUUUCUUUG | CAAAGAAACGAUCAUACUG |
| 1387 | 1388 | 930-948 | AGUAUGAUCGUUUCUUUGA | UCAAAGAAACGAUCAUACU |
| 1389 | 1390 | 931-949 | GUAUGAUCGUUUCUUUGAG | CUCAAAGAAACGAUCAUAC |
| 1391 | 1392 | 933-951 | AUGAUCGUUUCUUUGAGAA | UUCUCAAAGAAACGAUCAU |
| 1393 | 1394 | 934-952 | UGAUCGUUUCUUUGAGAAA | UUUCUCAAAGAAACGAUCA |
| 1395 | 1396 | 936-954 | AUCGUUUCUUUGAGAAAAA | UUUUUCUCAAAGAAACGAU |
| 1397 | 1398 | 937-955 | UCGUUUCUUUGAGAAAAAA | UUUUUUCUCAAAGAAACGA |
| 1399 | 1400 | 938-956 | CGUUUCUUUGAGAAAAAAU | UUUUUUUCUCAAAGAAACG |
| 1401 | 1402 | 939-957 | GUUUCUUUGAGAAAAAAUU | AUUUUUUUCUCAAAGAAAC |
| 1403 | 1404 | 940-958 | UUUCUUUGAGAAAAAAUU | AAUUUUUUUCUCAAAGAAA |
| 1405 | 1406 | 941-959 | UUCUUUGAGAAAAAAUUG | CAAUUUUUUUCUCAAAGAA |

TABLE 9-continued

Human ALAS1 siRNA Sense and Antisense Sequences

| SEQ ID NO: (sense) | SEQ ID NO: (antisense) | Position on transcript NM_000688.4 | Sense Sequence (5'-3') | Antisense Sequence (5'-3') |
|---|---|---|---|---|
| 1407 | 1408 | 942-960 | UCUUUGAGAAAAAAUUGA | UCAAUUUUUUCUCAAAGA |
| 1409 | 1410 | 943-961 | CUUUGAGAAAAAAUUGAU | AUCAAUUUUUUCUCAAAG |
| 1411 | 1412 | 944-962 | UUUGAGAAAAAAUUGAUG | CAUCAAUUUUUUCUCAAA |
| 1413 | 1414 | 945-963 | UUGAGAAAAAAUUGAUGA | UCAUCAAUUUUUUCUCAA |
| 1415 | 1416 | 946-964 | UGAGAAAAAAUUGAUGAG | CUCAUCAAUUUUUUCUCA |
| 1417 | 1418 | 947-965 | GAGAAAAAAUUGAUGAGA | UCUCAUCAAUUUUUUCUC |
| 1419 | 1420 | 948-966 | AGAAAAAAUUGAUGAGAA | UUCUCAUCAAUUUUUUCU |
| 1421 | 1422 | 949-967 | GAAAAAAUUGAUGAGAAA | UUUCUCAUCAAUUUUUUC |
| 1423 | 1424 | 950-968 | AAAAAAUUGAUGAGAAAA | UUUUCUCAUCAAUUUUUU |
| 1425 | 1426 | 951-969 | AAAAAUUGAUGAGAAAAA | UUUUUCUCAUCAAUUUUU |
| 1427 | 1428 | 952-970 | AAAAUUGAUGAGAAAAAG | CUUUUUCUCAUCAAUUUU |
| 1429 | 1430 | 953-971 | AAAUUGAUGAGAAAAAGA | UCUUUUUCUCAUCAAUUU |
| 1431 | 1432 | 954-972 | AAUUGAUGAGAAAAAGAA | UUCUUUUUCUCAUCAAUU |
| 1433 | 1434 | 955-973 | AUUGAUGAGAAAAAGAAU | AUUCUUUUUCUCAUCAAU |
| 1435 | 1436 | 956-974 | UUGAUGAGAAAAAGAAUG | CAUUCUUUUUCUCAUCAA |
| 1437 | 1438 | 957-975 | UGAUGAGAAAAAGAAUGA | UCAUUCUUUUUCUCAUCA |
| 1439 | 1440 | 958-976 | GAUGAGAAAAAGAAUGAC | GUCAUUCUUUUUCUCAUC |
| 1441 | 1442 | 959-977 | AUGAGAAAAAGAAUGACC | GGUCAUUCUUUUUCUCAU |
| 1443 | 1444 | 960-978 | UGAGAAAAAGAAUGACCA | UGGUCAUUCUUUUUCUCA |
| 1445 | 1446 | 961-979 | GAGAAAAAGAAUGACCAC | GUGGUCAUUCUUUUUCUC |
| 1447 | 1448 | 962-980 | AGAAAAAGAAUGACCACA | UGUGGUCAUUCUUUUUCU |
| 1449 | 1450 | 963-981 | GAAAAAGAAUGACCACAC | GUGUGGUCAUUCUUUUUC |
| 1451 | 1452 | 964-982 | AAAAAGAAUGACCACACC | GGUGUGGUCAUUCUUUUU |
| 1453 | 1454 | 965-983 | AAAAGAAUGACCACACCU | AGGUGUGGUCAUUCUUUU |
| 1455 | 1456 | 966-984 | AAAGAAUGACCACACCUA | UAGGUGUGGUCAUUCUUU |
| 1457 | 1458 | 967-985 | AAGAAUGACCACACCUAU | AUAGGUGUGGUCAUUCUU |
| 1459 | 1460 | 968-986 | AGAAUGACCACACCUAUC | GAUAGGUGUGGUCAUUCU |
| 1461 | 1462 | 969-987 | GAAUGACCACACCUAUCG | CGAUAGGUGUGGUCAUUC |
| 1463 | 1464 | 970-988 | AAUGACCACACCUAUCGA | UCGAUAGGUGUGGUCAUU |
| 1465 | 1466 | 971-989 | AUGACCACACCUAUCGAG | CUCGAUAGGUGUGGUCAU |
| 1467 | 1468 | 972-990 | UGACCACACCUAUCGAGU | ACUCGAUAGGUGUGGUCA |
| 1469 | 1470 | 976-994 | CCACACCUAUCGAGUUUU | AAAAACUCGAUAGGUGUGG |
| 1471 | 1472 | 977-995 | CACACCUAUCGAGUUUUA | UAAAACUCGAUAGGUGUG |
| 1473 | 1474 | 978-996 | ACACCUAUCGAGUUUUAA | UUAAAACUCGAUAGGUGU |
| 1475 | 1476 | 979-997 | CACCUAUCGAGUUUUUAAA | UUUAAAACUCGAUAGGUG |
| 1477 | 1478 | 980-998 | ACCUAUCGAGUUUUUAAAA | UUUUAAAACUCGAUAGGU |

TABLE 9-continued

Human ALAS1 siRNA Sense and Antisense Sequences

| SEQ ID NO: (sense) | SEQ ID NO: (anti-sense) | Position on transcript NM_000688.4 | Sense Sequence (5'-3') | Antisense Sequence (5'-3') |
| --- | --- | --- | --- | --- |
| 1479 | 1480 | 981-999 | CCUAUCGAGUUUUAAAAC | GUUUUAAAAACUCGAUAGG |
| 1481 | 1482 | 982-1000 | CUAUCGAGUUUUAAAACU | AGUUUUAAAAACUCGAUAG |
| 1483 | 1484 | 983-1001 | UAUCGAGUUUUAAAACUG | CAGUUUUAAAAACUCGAUA |
| 1485 | 1486 | 984-1002 | AUCGAGUUUUAAAACUGU | ACAGUUUUAAAAACUCGAU |
| 1487 | 1488 | 985-1003 | UCGAGUUUUAAAACUGUG | CACAGUUUUAAAAACUCGA |
| 1489 | 1490 | 986-1004 | CGAGUUUUAAAACUGUGA | UCACAGUUUUAAAAACUCG |
| 1491 | 1492 | 987-1005 | GAGUUUUAAAACUGUGAA | UUCACAGUUUUAAAAACUC |
| 1493 | 1494 | 988-1006 | AGUUUUAAAACUGUGAAC | GUUCACAGUUUUAAAAACU |
| 1495 | 1496 | 989-1007 | GUUUUAAAACUGUGAACC | GGUUCACAGUUUUAAAAAC |
| 1497 | 1498 | 990-1008 | UUUUAAAACUGUGAACCG | CGGUUCACAGUUUUAAAAA |
| 1499 | 1500 | 991-1009 | UUUAAAACUGUGAACCGG | CCGGUUCACAGUUUUAAAA |
| 1501 | 1502 | 992-1010 | UUAAAACUGUGAACCGGC | GCCGGUUCACAGUUUUAAA |
| 1503 | 1504 | 993-1011 | UAAAACUGUGAACCGGCG | CGCCGGUUCACAGUUUUAA |
| 1505 | 1506 | 994-1012 | AAAACUGUGAACCGGCGA | UCGCCGGUUCACAGUUUUA |
| 1507 | 1508 | 995-1013 | AAACUGUGAACCGGCGAG | CUCGCCGGUUCACAGUUUU |
| 1509 | 1510 | 996-1014 | AACUGUGAACCGGCGAGC | GCUCGCCGGUUCACAGUUU |
| 1511 | 1512 | 997-1015 | ACUGUGAACCGGCGAGCA | UGCUCGCCGGUUCACAGUU |
| 1513 | 1514 | 998-1016 | CUGUGAACCGGCGAGCAC | GUGCUCGCCGGUUCACAGU |
| 1515 | 1516 | 999-1017 | UGUGAACCGGCGAGCACA | UGUGCUCGCCGGUUCACAG |
| 1517 | 1518 | 1000-1018 | GUGAACCGGCGAGCACAC | GUGUGCUCGCCGGUUCACA |
| 1519 | 1520 | 1001-1019 | UGAACCGGCGAGCACACA | UGUGUGCUCGCCGGUUCAC |
| 1521 | 1522 | 1002-1020 | GAACCGGCGAGCACACAU | AUGUGUGCUCGCCGGUUCA |
| 1523 | 1524 | 1003-1021 | AACCGGCGAGCACACAUC | GAUGUGUGCUCGCCGGUUC |
| 1525 | 1526 | 1004-1022 | ACCGGCGAGCACACAUCU | AGAUGUGUGCUCGCCGGUU |
| 1527 | 1528 | 1005-1023 | CCGGCGAGCACACAUCUU | AAGAUGUGUGCUCGCCGGU |
| 1529 | 1530 | 1006-1024 | CGGCGAGCACACAUCUUC | GAAGAUGUGUGCUCGCCGG |
| 1531 | 1532 | 1007-1025 | GGCGAGCACACAUCUUCC | GGAAGAUGUGUGCUCGCCG |
| 1533 | 1534 | 1008-1026 | GCGAGCACACAUCUUCCC | GGGAAGAUGUGUGCUCGCC |
| 1535 | 1536 | 1028-1046 | AUGGCAGAUGACUAUUCAG | CUGAAUAGUCAUCUGCCAU |
| 1537 | 1538 | 1030-1048 | GGCAGAUGACUAUUCAGAC | GUCUGAAUAGUCAUCUGCC |
| 1539 | 1540 | 1031-1049 | GCAGAUGACUAUUCAGACU | AGUCUGAAUAGUCAUCUGC |
| 1541 | 1542 | 1032-1050 | CAGAUGACUAUUCAGACUC | GAGUCUGAAUAGUCAUCUG |
| 1543 | 1544 | 1033-1051 | AGAUGACUAUUCAGACUCC | GGAGUCUGAAUAGUCAUCU |
| 1545 | 1546 | 1034-1052 | GAUGACUAUUCAGACUCCC | GGGAGUCUGAAUAGUCAUC |
| 1547 | 1548 | 1035-1053 | AUGACUAUUCAGACUCCCU | AGGGAGUCUGAAUAGUCAU |
| 1549 | 1550 | 1036-1054 | UGACUAUUCAGACUCCCUC | GAGGGAGUCUGAAUAGUCA |

TABLE 9-continued

Human ALAS1 siRNA Sense and Antisense Sequences

| SEQ ID NO: (sense) | SEQ ID NO: (anti-sense) | Position on transcript NM_000688.4 | Sense Sequence (5'-3') | Antisense Sequence (5'-3') |
|---|---|---|---|---|
| 1551 | 1552 | 1037-1055 | GACUAUUCAGACUCCCUCA | UGAGGGAGUCUGAAUAGUC |
| 1553 | 1554 | 1038-1056 | ACUAUUCAGACUCCCUCAU | AUGAGGGAGUCUGAAUAGU |
| 1555 | 1556 | 1039-1057 | CUAUUCAGACUCCCUCAUC | GAUGAGGGAGUCUGAAUAG |
| 1557 | 1558 | 1040-1058 | UAUUCAGACUCCCUCAUCA | UGAUGAGGGAGUCUGAAUA |
| 1559 | 1560 | 1041-1059 | AUUCAGACUCCCUCAUCAC | GUGAUGAGGGAGUCUGAAU |
| 1561 | 1562 | 1042-1060 | UUCAGACUCCCUCAUCACC | GGUGAUGAGGGAGUCUGAA |
| 1563 | 1564 | 1043-1061 | UCAGACUCCCUCAUCACCA | UGGUGAUGAGGGAGUCUGA |
| 1565 | 1566 | 1044-1062 | CAGACUCCCUCAUCACCAA | UUGGUGAUGAGGGAGUCUG |
| 1567 | 1568 | 1045-1063 | AGACUCCCUCAUCACCAAA | UUUGGUGAUGAGGGAGUCU |
| 1569 | 1570 | 1046-1064 | GACUCCCUCAUCACCAAAA | UUUUGGUGAUGAGGGAGUC |
| 1571 | 1572 | 1047-1065 | ACUCCCUCAUCACCAAAAA | UUUUUGGUGAUGAGGGAGU |
| 1573 | 1574 | 1048-1066 | CUCCCUCAUCACCAAAAAG | CUUUUUGGUGAUGAGGGAG |
| 1575 | 1576 | 1049-1067 | UCCCUCAUCACCAAAAAGC | GCUUUUUGGUGAUGAGGGA |
| 1577 | 1578 | 1050-1068 | CCCUCAUCACCAAAAAGCA | UGCUUUUUGGUGAUGAGGG |
| 1579 | 1580 | 1070-1088 | GUGUCAGUCUGGUGCAGUA | UACUGCACCAGACUGACAC |
| 1581 | 1582 | 1071-1089 | UGUCAGUCUGGUGCAGUAA | UUACUGCACCAGACUGACA |
| 1583 | 1584 | 1072-1090 | GUCAGUCUGGUGCAGUAAU | AUUACUGCACCAGACUGAC |
| 1585 | 1586 | 1073-1091 | UCAGUCUGGUGCAGUAAUG | CAUUACUGCACCAGACUGA |
| 1587 | 1588 | 1074-1092 | CAGUCUGGUGCAGUAAUGA | UCAUUACUGCACCAGACUG |
| 1589 | 1590 | 1075-1093 | AGUCUGGUGCAGUAAUGAC | GUCAUUACUGCACCAGACU |
| 1591 | 1592 | 1078-1096 | CUGGUGCAGUAAUGACUAC | GUAGUCAUUACUGCACCAG |
| 1593 | 1594 | 1079-1097 | UGGUGCAGUAAUGACUACC | GGUAGUCAUUACUGCACCA |
| 1595 | 1596 | 1081-1099 | GUGCAGUAAUGACUACCUA | UAGGUAGUCAUUACUGCAC |
| 1597 | 1598 | 1082-1100 | UGCAGUAAUGACUACCUAG | CUAGGUAGUCAUUACUGCA |
| 1599 | 1600 | 1083-1101 | GCAGUAAUGACUACCUAGG | CCUAGGUAGUCAUUACUGC |
| 1601 | 1602 | 1084-1102 | CAGUAAUGACUACCUAGGA | UCCUAGGUAGUCAUUACUG |
| 1603 | 1604 | 1085-1103 | AGUAAUGACUACCUAGGAA | UUCCUAGGUAGUCAUUACU |
| 1605 | 1606 | 1086-1104 | GUAAUGACUACCUAGGAAU | AUUCCUAGGUAGUCAUUAC |
| 1607 | 1608 | 1087-1105 | UAAUGACUACCUAGGAAUG | CAUUCCUAGGUAGUCAUUA |
| 1609 | 1610 | 1088-1106 | AAUGACUACCUAGGAAUGA | UCAUUCCUAGGUAGUCAUU |
| 1611 | 1612 | 1089-1107 | AUGACUACCUAGGAAUGAG | CUCAUUCCUAGGUAGUCAU |
| 1613 | 1614 | 1090-1108 | UGACUACCUAGGAAUGAGU | ACUCAUUCCUAGGUAGUCA |
| 1615 | 1616 | 1091-1109 | GACUACCUAGGAAUGAGUC | GACUCAUUCCUAGGUAGUC |
| 1617 | 1618 | 1092-1110 | ACUACCUAGGAAUGAGUCG | CGACUCAUUCCUAGGUAGU |
| 1619 | 1620 | 1093-1111 | CUACCUAGGAAUGAGUCGC | GCGACUCAUUCCUAGGUAG |
| 1621 | 1622 | 1094-1112 | UACCUAGGAAUGAGUCGCC | GGCGACUCAUUCCUAGGUA |

TABLE 9-continued

Human ALAS1 siRNA Sense and Antisense Sequences

| SEQ ID NO: (sense) | SEQ ID NO: (anti-sense) | Position on transcript NM_000688.4 | Sense Sequence (5'-3') | Antisense Sequence (5'-3') |
|---|---|---|---|---|
| 1623 | 1624 | 1095-1113 | ACCUAGGAAUGAGUCGCCA | UGGCGACUCAUUCCUAGGU |
| 1625 | 1626 | 1096-1114 | CCUAGGAAUGAGUCGCCAC | GUGGCGACUCAUUCCUAGG |
| 1627 | 1628 | 1097-1115 | CUAGGAAUGAGUCGCCACC | GGUGGCGACUCAUUCCUAG |
| 1629 | 1630 | 1098-1116 | UAGGAAUGAGUCGCCACCC | GGGUGGCGACUCAUUCCUA |
| 1631 | 1632 | 1099-1117 | AGGAAUGAGUCGCCACCCA | UGGGUGGCGACUCAUUCCU |
| 1633 | 1634 | 1100-1118 | GGAAUGAGUCGCCACCCAC | GUGGGUGGCGACUCAUUCC |
| 1635 | 1636 | 1101-1119 | GAAUGAGUCGCCACCCACG | CGUGGGUGGCGACUCAUUC |
| 1637 | 1638 | 1102-1120 | AAUGAGUCGCCACCCACGG | CCGUGGGUGGCGACUCAUU |
| 1639 | 1640 | 1103-1121 | AUGAGUCGCCACCCACGGG | CCCGUGGGUGGCGACUCAU |
| 1641 | 1642 | 1104-1122 | UGAGUCGCCACCCACGGGU | ACCCGUGGGUGGCGACUCA |
| 1643 | 1644 | 1105-1123 | GAGUCGCCACCCACGGGUG | CACCCGUGGGUGGCGACUC |
| 1645 | 1646 | 1106-1124 | AGUCGCCACCCACGGGUGU | ACACCCGUGGGUGGCGACU |
| 1647 | 1648 | 1107-1125 | GUCGCCACCCACGGGUGUG | CACACCCGUGGGUGGCGAC |
| 1649 | 1650 | 1108-1126 | UCGCCACCCACGGGUGUGU | ACACACCCGUGGGUGGCGA |
| 1651 | 1652 | 1109-1127 | CGCCACCCACGGGUGUGUG | CACACACCCGUGGGUGGCG |
| 1653 | 1654 | 1110-1128 | GCCACCCACGGGUGUGUGG | CCACACACCCGUGGGUGGC |
| 1655 | 1656 | 1111-1129 | CCACCCACGGGUGUGUGGG | CCCACACACCCGUGGGUGG |
| 1657 | 1658 | 1112-1130 | CACCCACGGGUGUGUGGGG | CCCCACACACCCGUGGGUG |
| 1659 | 1660 | 1113-1131 | ACCCACGGGUGUGUGGGGC | GCCCCACACACCCGUGGGU |
| 1661 | 1662 | 1114-1132 | CCCACGGGUGUGUGGGGCA | UGCCCCACACACCCGUGGG |
| 1663 | 1664 | 1115-1133 | CCACGGGUGUGUGGGGCAG | CUGCCCCACACACCCGUGG |
| 1665 | 1666 | 1116-1134 | CACGGGUGUGUGGGGCAGU | ACUGCCCCACACACCCGUG |
| 1667 | 1668 | 1117-1135 | ACGGGUGUGUGGGGCAGUU | AACUGCCCCACACACCCGU |
| 1669 | 1670 | 1118-1136 | CGGGUGUGUGGGGCAGUUA | UAACUGCCCCACACACCCG |
| 1671 | 1672 | 1119-1137 | GGGUGUGUGGGGCAGUUAU | AUAACUGCCCCACACACCC |
| 1673 | 1674 | 1120-1138 | GGUGUGUGGGGCAGUUAUG | CAUAACUGCCCCACACACC |
| 1675 | 1676 | 1121-1139 | GUGUGUGGGGCAGUUAUGG | CCAUAACUGCCCCACACAC |
| 1677 | 1678 | 1122-1140 | UGUGUGGGGCAGUUAUGGA | UCCAUAACUGCCCCACACA |
| 1679 | 1680 | 1123-1141 | GUGUGGGGCAGUUAUGGAC | GUCCAUAACUGCCCCACAC |
| 1681 | 1682 | 1125-1143 | GUGGGGCAGUUAUGGACAC | GUGUCCAUAACUGCCCCAC |
| 1683 | 1684 | 1126-1144 | UGGGGCAGUUAUGGACACU | AGUGUCCAUAACUGCCCCA |
| 1685 | 1686 | 1128-1146 | GGGCAGUUAUGGACACUUU | AAAGUGUCCAUAACUGCCC |
| 1687 | 1688 | 1129-1147 | GGCAGUUAUGGACACUUUG | CAAAGUGUCCAUAACUGCC |
| 1689 | 1690 | 1130-1148 | GCAGUUAUGGACACUUUGA | UCAAAGUGUCCAUAACUGC |
| 1691 | 1692 | 1131-1149 | CAGUUAUGGACACUUUGAA | UUCAAAGUGUCCAUAACUG |
| 1693 | 1694 | 1132-1150 | AGUUAUGGACACUUUGAAA | UUUCAAAGUGUCCAUAACU |

TABLE 9-continued

Human ALAS1 siRNA Sense and Antisense Sequences

| SEQ ID NO: (sense) | SEQ ID NO: (anti-sense) | Position on transcript NM_000688.4 | Sense Sequence (5'-3') | Antisense Sequence (5'-3') |
|---|---|---|---|---|
| 1695 | 1696 | 1133-1151 | GUUAUGGACACUUUGAAAC | GUUUCAAAGUGUCCAUAAC |
| 1697 | 1698 | 1134-1152 | UUAUGGACACUUUGAAACA | UGUUUCAAAGUGUCCAUAA |
| 1699 | 1700 | 1135-1153 | UAUGGACACUUUGAAACAA | UUGUUUCAAAGUGUCCAUA |
| 1701 | 1702 | 1136-1154 | AUGGACACUUUGAAACAAC | GUUGUUUCAAAGUGUCCAU |
| 1703 | 1704 | 1139-1157 | GACACUUUGAAACAACAUG | CAUGUUGUUUCAAAGUGUC |
| 1705 | 1706 | 1140-1158 | ACACUUUGAAACAACAUGG | CCAUGUUGUUUCAAAGUGU |
| 1707 | 1708 | 1141-1159 | CACUUUGAAACAACAUGGU | ACCAUGUUGUUUCAAAGUG |
| 1709 | 1710 | 1142-1160 | ACUUUGAAACAACAUGGUG | CACCAUGUUGUUUCAAAGU |
| 1711 | 1712 | 1143-1161 | CUUUGAAACAACAUGGUGC | GCACCAUGUUGUUUCAAAG |
| 1713 | 1714 | 1144-1162 | UUUGAAACAACAUGGUGCU | AGCACCAUGUUGUUUCAAA |
| 1715 | 1716 | 1145-1163 | UUGAAACAACAUGGUGCUG | CAGCACCAUGUUGUUUCAA |
| 1717 | 1718 | 1146-1164 | UGAAACAACAUGGUGCUGG | CCAGCACCAUGUUGUUUCA |
| 1719 | 1720 | 1147-1165 | GAAACAACAUGGUGCUGGG | CCCAGCACCAUGUUGUUUC |
| 1721 | 1722 | 1148-1166 | AAACAACAUGGUGCUGGGG | CCCCAGCACCAUGUUGUUU |
| 1723 | 1724 | 1149-1167 | AACAACAUGGUGCUGGGGC | GCCCCAGCACCAUGUUGUU |
| 1725 | 1726 | 1150-1168 | ACAACAUGGUGCUGGGGCA | UGCCCCAGCACCAUGUUGU |
| 1727 | 1728 | 1151-1169 | CAACAUGGUGCUGGGGCAG | CUGCCCCAGCACCAUGUUG |
| 1729 | 1730 | 1152-1170 | AACAUGGUGCUGGGGCAGG | CCUGCCCCAGCACCAUGUU |
| 1731 | 1732 | 1153-1171 | ACAUGGUGCUGGGGCAGGU | ACCUGCCCCAGCACCAUGU |
| 1733 | 1734 | 1154-1172 | CAUGGUGCUGGGGCAGGUG | CACCUGCCCCAGCACCAUG |
| 1735 | 1736 | 1155-1173 | AUGGUGCUGGGGCAGGUGG | CCACCUGCCCCAGCACCAU |
| 1737 | 1738 | 1156-1174 | UGGUGCUGGGGCAGGUGGU | ACCACCUGCCCCAGCACCA |
| 1739 | 1740 | 1157-1175 | GGUGCUGGGGCAGGUGGUA | UACCACCUGCCCCAGCACC |
| 1741 | 1742 | 1158-1176 | GUGCUGGGGCAGGUGGUAC | GUACCACCUGCCCCAGCAC |
| 1743 | 1744 | 1159-1177 | UGCUGGGGCAGGUGGUACU | AGUACCACCUGCCCCAGCA |
| 1745 | 1746 | 1160-1178 | GCUGGGGCAGGUGGUACUA | UAGUACCACCUGCCCCAGC |
| 1747 | 1748 | 1161-1179 | CUGGGGCAGGUGGUACUAG | CUAGUACCACCUGCCCCAG |
| 1749 | 1750 | 1162-1180 | UGGGGCAGGUGGUACUAGA | UCUAGUACCACCUGCCCCA |
| 1751 | 1752 | 1166-1184 | GCAGGUGGUACUAGAAAUA | UAUUUCUAGUACCACCUGC |
| 1753 | 1754 | 1167-1185 | CAGGUGGUACUAGAAAUAU | AUAUUUCUAGUACCACCUG |
| 1755 | 1756 | 1168-1186 | AGGUGGUACUAGAAAUAUU | AAUAUUUCUAGUACCACCU |
| 1757 | 1758 | 1169-1187 | GGUGGUACUAGAAAUAUUU | AAAUAUUUCUAGUACCACC |
| 1759 | 1760 | 1170-1188 | GUGGUACUAGAAAUAUUUC | GAAAUAUUUCUAGUACCAC |
| 1761 | 1762 | 1171-1189 | UGGUACUAGAAAUAUUUCU | AGAAAUAUUUCUAGUACCA |
| 1763 | 1764 | 1172-1190 | GGUACUAGAAAUAUUUCUG | CAGAAAUAUUUCUAGUACC |
| 1765 | 1766 | 1173-1191 | GUACUAGAAAUAUUUCUGG | CCAGAAAUAUUUCUAGUAC |

TABLE 9-continued

Human ALAS1 siRNA Sense and Antisense Sequences

| SEQ ID NO: (sense) | SEQ ID NO: (anti-sense) | Position on transcript NM_000688.4 | Sense Sequence (5'-3') | Antisense Sequence (5'-3') |
|---|---|---|---|---|
| 1767 | 1768 | 1174-1192 | UACUAGAAAUAUUUCUGGA | UCCAGAAAUAUUUCUAGUA |
| 1769 | 1770 | 1175-1193 | ACUAGAAAUAUUUCUGGAA | UUCCAGAAAUAUUUCUAGU |
| 1771 | 1772 | 1176-1194 | CUAGAAAUAUUUCUGGAAC | GUUCCAGAAAUAUUUCUAG |
| 1773 | 1774 | 1177-1195 | UAGAAAUAUUUCUGGAACU | AGUUCCAGAAAUAUUUCUA |
| 1775 | 1776 | 1178-1196 | AGAAAUAUUUCUGGAACUA | UAGUUCCAGAAAUAUUUCU |
| 1777 | 1778 | 1179-1197 | GAAAUAUUUCUGGAACUAG | CUAGUUCCAGAAAUAUUUC |
| 1779 | 1780 | 1180-1198 | AAAUAUUUCUGGAACUAGU | ACUAGUUCCAGAAAUAUUU |
| 1781 | 1782 | 1181-1199 | AAUAUUUCUGGAACUAGUA | UACUAGUUCCAGAAAUAUU |
| 1783 | 1784 | 1183-1201 | UAUUUCUGGAACUAGUAAA | UUUACUAGUUCCAGAAAUA |
| 1785 | 1786 | 1186-1204 | UUCUGGAACUAGUAAAUUC | GAAUUUACUAGUUCCAGAA |
| 1787 | 1788 | 1187-1205 | UCUGGAACUAGUAAAUUCC | GGAAUUUACUAGUUCCAGA |
| 1789 | 1790 | 1189-1207 | UGGAACUAGUAAAUUCCAU | AUGGAAUUUACUAGUUCCA |
| 1791 | 1792 | 1190-1208 | GGAACUAGUAAAUUCCAUG | CAUGGAAUUUACUAGUUCC |
| 1793 | 1794 | 1192-1210 | AACUAGUAAAUUCCAUGUG | CACAUGGAAUUUACUAGUU |
| 1795 | 1796 | 1193-1211 | ACUAGUAAAUUCCAUGUGG | CCACAUGGAAUUUACUAGU |
| 1797 | 1798 | 1194-1212 | CUAGUAAAUUCCAUGUGGA | UCCACAUGGAAUUUACUAG |
| 1799 | 1800 | 1195-1213 | UAGUAAAUUCCAUGUGGAC | GUCCACAUGGAAUUUACUA |
| 1801 | 1802 | 1196-1214 | AGUAAAUUCCAUGUGGACU | AGUCCACAUGGAAUUUACU |
| 1803 | 1804 | 1197-1215 | GUAAAUUCCAUGUGGACUU | AAGUCCACAUGGAAUUUAC |
| 1805 | 1806 | 1198-1216 | UAAAUUCCAUGUGGACUUA | UAAGUCCACAUGGAAUUUA |
| 1807 | 1808 | 1199-1217 | AAAUUCCAUGUGGACUUAG | CUAAGUCCACAUGGAAUUU |
| 1809 | 1810 | 1200-1218 | AAUUCCAUGUGGACUUAGA | UCUAAGUCCACAUGGAAUU |
| 1811 | 1812 | 1201-1219 | AUUCCAUGUGGACUUAGAG | CUCUAAGUCCACAUGGAAU |
| 1813 | 1814 | 1202-1220 | UUCCAUGUGGACUUAGAGC | GCUCUAAGUCCACAUGGAA |
| 1815 | 1816 | 1222-1240 | GGAGCUGGCAGACCUCCAU | AUGGAGGUCUGCCAGCUCC |
| 1817 | 1818 | 1223-1241 | GAGCUGGCAGACCUCCAUG | CAUGGAGGUCUGCCAGCUC |
| 1819 | 1820 | 1224-1242 | AGCUGGCAGACCUCCAUGG | CCAUGGAGGUCUGCCAGCU |
| 1821 | 1822 | 1225-1243 | GCUGGCAGACCUCCAUGGG | CCCAUGGAGGUCUGCCAGC |
| 1823 | 1824 | 1226-1244 | CUGGCAGACCUCCAUGGGA | UCCCAUGGAGGUCUGCCAG |
| 1825 | 1826 | 1227-1245 | UGGCAGACCUCCAUGGGAA | UUCCCAUGGAGGUCUGCCA |
| 1827 | 1828 | 1228-1246 | GGCAGACCUCCAUGGGAAA | UUUCCCAUGGAGGUCUGCC |
| 1829 | 1830 | 1229-1247 | GCAGACCUCCAUGGGAAAG | CUUUCCCAUGGAGGUCUGC |
| 1831 | 1832 | 1230-1248 | CAGACCUCCAUGGGAAAGA | UCUUUCCCAUGGAGGUCUG |
| 1833 | 1834 | 1231-1249 | AGACCUCCAUGGGAAAGAU | AUCUUUCCCAUGGAGGUCU |
| 1835 | 1836 | 1232-1250 | GACCUCCAUGGGAAAGAUG | CAUCUUUCCCAUGGAGGUC |
| 1837 | 1838 | 1233-1251 | ACCUCCAUGGGAAAGAUGC | GCAUCUUUCCCAUGGAGGU |

TABLE 9-continued

Human ALAS1 siRNA Sense and Antisense Sequences

| SEQ ID NO: (sense) | SEQ ID NO: (antisense) | Position on transcript NM_000688.4 | Sense Sequence (5'-3') | Antisense Sequence (5'-3') |
|---|---|---|---|---|
| 1839 | 1840 | 1254-1272 | CACUCUUGUUUUCCUCGUG | CACGAGGAAAACAAGAGUG |
| 1841 | 1842 | 1255-1273 | ACUCUUGUUUUCCUCGUGC | GCACGAGGAAAACAAGAGU |
| 1843 | 1844 | 1256-1274 | CUCUUGUUUUCCUCGUGCU | AGCACGAGGAAAACAAGAG |
| 1845 | 1846 | 1257-1275 | UCUUGUUUUCCUCGUGCUU | AAGCACGAGGAAAACAAGA |
| 1847 | 1848 | 1259-1277 | UUGUUUUCCUCGUGCUUUG | CAAAGCACGAGGAAAACAA |
| 1849 | 1850 | 1260-1278 | UGUUUUCCUCGUGCUUUGU | ACAAAGCACGAGGAAAACA |
| 1851 | 1852 | 1261-1279 | GUUUUCCUCGUGCUUUGUG | CACAAAGCACGAGGAAAAC |
| 1853 | 1854 | 1262-1280 | UUUUCCUCGUGCUUUGUGG | CCACAAAGCACGAGGAAAA |
| 1855 | 1856 | 1263-1281 | UUUCCUCGUGCUUUGUGGC | GCCACAAAGCACGAGGAAA |
| 1857 | 1858 | 1264-1282 | UUCCUCGUGCUUUGUGGCC | GGCCACAAAGCACGAGGAA |
| 1859 | 1860 | 1265-1283 | UCCUCGUGCUUUGUGGCCA | UGGCCACAAAGCACGAGGA |
| 1861 | 1862 | 1266-1284 | CCUCGUGCUUUGUGGCCAA | UUGGCCACAAAGCACGAGG |
| 1863 | 1864 | 1267-1285 | CUCGUGCUUUGUGGCCAAU | AUUGGCCACAAAGCACGAG |
| 1865 | 1866 | 1268-1286 | UCGUGCUUUGUGGCCAAUG | CAUUGGCCACAAAGCACGA |
| 1867 | 1868 | 1269-1287 | CGUGCUUUGUGGCCAAUGA | UCAUUGGCCACAAAGCACG |
| 1869 | 1870 | 1270-1288 | GUGCUUUGUGGCCAAUGAC | GUCAUUGGCCACAAAGCAC |
| 1871 | 1872 | 1271-1289 | UGCUUUGUGGCCAAUGACU | AGUCAUUGGCCACAAAGCA |
| 1873 | 1874 | 1272-1290 | GCUUUGUGGCCAAUGACUC | GAGUCAUUGGCCACAAAGC |
| 1875 | 1876 | 1273-1291 | CUUUGUGGCCAAUGACUCA | UGAGUCAUUGGCCACAAAG |
| 1877 | 1878 | 1274-1292 | UUUGUGGCCAAUGACUCAA | UUGAGUCAUUGGCCACAAA |
| 1879 | 1880 | 1275-1293 | UUGUGGCCAAUGACUCAAC | GUUGAGUCAUUGGCCACAA |
| 1881 | 1882 | 1276-1294 | UGUGGCCAAUGACUCAACC | GGUUGAGUCAUUGGCCACA |
| 1883 | 1884 | 1277-1295 | GUGGCCAAUGACUCAACCC | GGGUUGAGUCAUUGGCCAC |
| 1885 | 1886 | 1278-1296 | UGGCCAAUGACUCAACCCU | AGGGUUGAGUCAUUGGCCA |
| 1887 | 1888 | 1279-1297 | GGCCAAUGACUCAACCCUC | GAGGGUUGAGUCAUUGGCC |
| 1889 | 1890 | 1280-1298 | GCCAAUGACUCAACCCUCU | AGAGGGUUGAGUCAUUGGC |
| 1891 | 1892 | 1281-1299 | CCAAUGACUCAACCCUCUU | AAGAGGGUUGAGUCAUUGG |
| 1893 | 1894 | 1282-1300 | CAAUGACUCAACCCUCUUC | GAAGAGGGUUGAGUCAUUG |
| 1895 | 1896 | 1283-1301 | AAUGACUCAACCCUCUUCA | UGAAGAGGGUUGAGUCAUU |
| 1897 | 1898 | 1284-1302 | AUGACUCAACCCUCUUCAC | GUGAAGAGGGUUGAGUCAU |
| 1899 | 1900 | 1285-1303 | UGACUCAACCCUCUUCACC | GGUGAAGAGGGUUGAGUCA |
| 1901 | 1902 | 1286-1304 | GACUCAACCCUCUUCACCC | GGGUGAAGAGGGUUGAGUC |
| 1903 | 1904 | 1287-1305 | ACUCAACCCUCUUCACCCU | AGGGUGAAGAGGGUUGAGU |
| 1905 | 1906 | 1288-1306 | CUCAACCCUCUUCACCCUG | CAGGGUGAAGAGGGUUGAG |
| 1907 | 1908 | 1289-1307 | UCAACCCUCUUCACCCUGG | CCAGGGUGAAGAGGGUUGA |
| 1909 | 1910 | 1290-1308 | CAACCCUCUUCACCCUGGC | GCCAGGGUGAAGAGGGUUG |

TABLE 9-continued

Human ALAS1 siRNA Sense and Antisense Sequences

| SEQ ID NO: (sense) | SEQ ID NO: (antisense) | Position on transcript NM_000688.4 | Sense Sequence (5'-3') | Antisense Sequence (5'-3') |
|---|---|---|---|---|
| 1911 | 1912 | 1291-1309 | AACCCUCUUCACCCUGGCU | AGCCAGGGUGAAGAGGGUU |
| 1913 | 1914 | 1292-1310 | ACCCUCUUCACCCUGGCUA | UAGCCAGGGUGAAGAGGGU |
| 1915 | 1916 | 1293-1311 | CCCUCUUCACCCUGGCUAA | UUAGCCAGGGUGAAGAGGG |
| 1917 | 1918 | 1294-1312 | CCUCUUCACCCUGGCUAAG | CUUAGCCAGGGUGAAGAGG |
| 1919 | 1920 | 1297-1315 | CUUCACCCUGGCUAAGAUG | CAUCUUAGCCAGGGUGAAG |
| 1921 | 1922 | 1298-1316 | UUCACCCUGGCUAAGAUGA | UCAUCUUAGCCAGGGUGAA |
| 1923 | 1924 | 1300-1318 | CACCCUGGCUAAGAUGAUG | CAUCAUCUUAGCCAGGGUG |
| 1925 | 1926 | 1301-1319 | ACCCUGGCUAAGAUGAUGC | GCAUCAUCUUAGCCAGGGU |
| 1927 | 1928 | 1302-1320 | CCCUGGCUAAGAUGAUGCC | GGCAUCAUCUUAGCCAGGG |
| 1929 | 1930 | 1303-1321 | CCUGGCUAAGAUGAUGCCA | UGGCAUCAUCUUAGCCAGG |
| 1931 | 1932 | 1304-1322 | CUGGCUAAGAUGAUGCCAG | CUGGCAUCAUCUUAGCCAG |
| 1933 | 1934 | 1305-1323 | UGGCUAAGAUGAUGCCAGG | CCUGGCAUCAUCUUAGCCA |
| 1935 | 1936 | 1306-1324 | GGCUAAGAUGAUGCCAGGC | GCCUGGCAUCAUCUUAGCC |
| 1937 | 1938 | 1307-1325 | GCUAAGAUGAUGCCAGGCU | AGCCUGGCAUCAUCUUAGC |
| 1939 | 1940 | 1308-1326 | CUAAGAUGAUGCCAGGCUG | CAGCCUGGCAUCAUCUUAG |
| 1941 | 1942 | 1309-1327 | UAAGAUGAUGCCAGGCUGU | ACAGCCUGGCAUCAUCUUA |
| 1943 | 1944 | 1310-1328 | AAGAUGAUGCCAGGCUGUG | CACAGCCUGGCAUCAUCUU |
| 1945 | 1946 | 1311-1329 | AGAUGAUGCCAGGCUGUGA | UCACAGCCUGGCAUCAUCU |
| 1947 | 1948 | 1312-1330 | GAUGAUGCCAGGCUGUGAG | CUCACAGCCUGGCAUCAUC |
| 1949 | 1950 | 1313-1331 | AUGAUGCCAGGCUGUGAGA | UCUCACAGCCUGGCAUCAU |
| 1951 | 1952 | 1314-1332 | UGAUGCCAGGCUGUGAGAU | AUCUCACAGCCUGGCAUCA |
| 1953 | 1954 | 1316-1334 | AUGCCAGGCUGUGAGAUUU | AAAUCUCACAGCCUGGCAU |
| 1955 | 1956 | 1317-1335 | UGCCAGGCUGUGAGAUUUA | UAAAUCUCACAGCCUGGCA |
| 1957 | 1958 | 1318-1336 | GCCAGGCUGUGAGAUUUAC | GUAAAUCUCACAGCCUGGC |
| 1959 | 1960 | 1319-1337 | CCAGGCUGUGAGAUUUACU | AGUAAAUCUCACAGCCUGG |
| 1961 | 1962 | 1320-1338 | CAGGCUGUGAGAUUUACUC | GAGUAAAUCUCACAGCCUG |
| 1963 | 1964 | 1321-1339 | AGGCUGUGAGAUUUACUCU | AGAGUAAAUCUCACAGCCU |
| 1965 | 1966 | 1322-1340 | GGCUGUGAGAUUUACUCUG | CAGAGUAAAUCUCACAGCC |
| 1967 | 1968 | 1323-1341 | GCUGUGAGAUUUACUCUGA | UCAGAGUAAAUCUCACAGC |
| 1969 | 1970 | 1326-1344 | GUGAGAUUUACUCUGAUUC | GAAUCAGAGUAAAUCUCAC |
| 1971 | 1972 | 1327-1345 | UGAGAUUUACUCUGAUUCU | AGAAUCAGAGUAAAUCUCA |
| 1973 | 1974 | 1328-1346 | GAGAUUUACUCUGAUUCUG | CAGAAUCAGAGUAAAUCUC |
| 1975 | 1976 | 1329-1347 | AGAUUUACUCUGAUUCUGG | CCAGAAUCAGAGUAAAUCU |
| 1977 | 1978 | 1330-1348 | GAUUUACUCUGAUUCUGGG | CCCAGAAUCAGAGUAAAUC |
| 1979 | 1980 | 1331-1349 | AUUUACUCUGAUUCUGGGA | UCCCAGAAUCAGAGUAAAU |
| 1981 | 1982 | 1332-1350 | UUUACUCUGAUUCUGGGAA | UUCCCAGAAUCAGAGUAAA |

TABLE 9-continued

Human ALAS1 siRNA Sense and Antisense Sequences

| SEQ ID NO: (sense) | SEQ ID NO: (anti-sense) | Position on transcript NM_000688.4 | Sense Sequence (5'-3') | Antisense Sequence (5'-3') |
|---|---|---|---|---|
| 1983 | 1984 | 1333-1351 | UUACUCUGAUUCUGGGAAC | GUUCCCAGAAUCAGAGUAA |
| 1985 | 1986 | 1334-1352 | UACUCUGAUUCUGGGAACC | GGUUCCCAGAAUCAGAGUA |
| 1987 | 1988 | 1335-1353 | ACUCUGAUUCUGGGAACCA | UGGUUCCCAGAAUCAGAGU |
| 1989 | 1990 | 1336-1354 | CUCUGAUUCUGGGAACCAU | AUGGUUCCCAGAAUCAGAG |
| 1991 | 1992 | 1337-1355 | UCUGAUUCUGGGAACCAUG | CAUGGUUCCCAGAAUCAGA |
| 1993 | 1994 | 1338-1356 | CUGAUUCUGGGAACCAUGC | GCAUGGUUCCCAGAAUCAG |
| 1995 | 1996 | 1339-1357 | UGAUUCUGGGAACCAUGCC | GGCAUGGUUCCCAGAAUCA |
| 1997 | 1998 | 1340-1358 | GAUUCUGGGAACCAUGCCU | AGGCAUGGUUCCCAGAAUC |
| 1999 | 2000 | 1341-1359 | AUUCUGGGAACCAUGCCUC | GAGGCAUGGUUCCCAGAAU |
| 2001 | 2002 | 1342-1360 | UUCUGGGAACCAUGCCUCC | GGAGGCAUGGUUCCCAGAA |
| 2003 | 2004 | 1343-1361 | UCUGGGAACCAUGCCUCCA | UGGAGGCAUGGUUCCCAGA |
| 2005 | 2006 | 1344-1362 | CUGGGAACCAUGCCUCCAU | AUGGAGGCAUGGUUCCCAG |
| 2007 | 2008 | 1345-1363 | UGGGAACCAUGCCUCCAUG | CAUGGAGGCAUGGUUCCCA |
| 2009 | 2010 | 1346-1364 | GGGAACCAUGCCUCCAUGA | UCAUGGAGGCAUGGUUCCC |
| 2011 | 2012 | 1348-1366 | GAACCAUGCCUCCAUGAUC | GAUCAUGGAGGCAUGGUUC |
| 2013 | 2014 | 1349-1367 | AACCAUGCCUCCAUGAUCC | GGAUCAUGGAGGCAUGGUU |
| 2015 | 2016 | 1350-1368 | ACCAUGCCUCCAUGAUCCA | UGGAUCAUGGAGGCAUGGU |
| 2017 | 2018 | 1351-1369 | CCAUGCCUCCAUGAUCCAA | UUGGAUCAUGGAGGCAUGG |
| 2019 | 2020 | 1352-1370 | CAUGCCUCCAUGAUCCAAG | CUUGGAUCAUGGAGGCAUG |
| 2021 | 2022 | 1353-1371 | AUGCCUCCAUGAUCCAAGG | CCUUGGAUCAUGGAGGCAU |
| 2023 | 2024 | 1354-1372 | UGCCUCCAUGAUCCAAGGG | CCCUUGGAUCAUGGAGGCA |
| 2025 | 2026 | 1358-1376 | UCCAUGAUCCAAGGGAUUC | GAAUCCCUUGGAUCAUGGA |
| 2027 | 2028 | 1359-1377 | CCAUGAUCCAAGGGAUUCG | CGAAUCCCUUGGAUCAUGG |
| 2029 | 2030 | 1360-1378 | CAUGAUCCAAGGGAUUCGA | UCGAAUCCCUUGGAUCAUG |
| 2031 | 2032 | 1361-1379 | AUGAUCCAAGGGAUUCGAA | UUCGAAUCCCUUGGAUCAU |
| 2033 | 2034 | 1362-1380 | UGAUCCAAGGGAUUCGAAA | UUUCGAAUCCCUUGGAUCA |
| 2035 | 2036 | 1363-1381 | GAUCCAAGGGAUUCGAAAC | GUUUCGAAUCCCUUGGAUC |
| 2037 | 2038 | 1365-1383 | UCCAAGGGAUUCGAAACAG | CUGUUUCGAAUCCCUUGGA |
| 2039 | 2040 | 1366-1384 | CCAAGGGAUUCGAAACAGC | GCUGUUUCGAAUCCCUUGG |
| 2041 | 2042 | 1367-1385 | CAAGGGAUUCGAAACAGCC | GGCUGUUUCGAAUCCCUUG |
| 2043 | 2044 | 1368-1386 | AAGGGAUUCGAAACAGCCG | CGGCUGUUUCGAAUCCCUU |
| 2045 | 2046 | 1369-1387 | AGGGAUUCGAAACAGCCGA | UCGGCUGUUUCGAAUCCCU |
| 2047 | 2048 | 1370-1388 | GGGAUUCGAAACAGCCGAG | CUCGGCUGUUUCGAAUCCC |
| 2049 | 2050 | 1371-1389 | GGAUUCGAAACAGCCGAGU | ACUCGGCUGUUUCGAAUCC |
| 2051 | 2052 | 1372-1390 | GAUUCGAAACAGCCGAGUG | CACUCGGCUGUUUCGAAUC |
| 2053 | 2054 | 1373-1391 | AUUCGAAACAGCCGAGUGC | GCACUCGGCUGUUUCGAAU |

TABLE 9-continued

Human ALAS1 siRNA Sense and Antisense Sequences

| SEQ ID NO: (sense) | SEQ ID NO: (antisense) | Position on transcript NM_000688.4 | Sense Sequence (5'-3') | Antisense Sequence (5'-3') |
|---|---|---|---|---|
| 2055 | 2056 | 1374-1392 | UUCGAAACAGCCGAGUGCC | GGCACUCGGCUGUUUCGAA |
| 2057 | 2058 | 1375-1393 | UCGAAACAGCCGAGUGCCA | UGGCACUCGGCUGUUUCGA |
| 2059 | 2060 | 1376-1394 | CGAAACAGCCGAGUGCCAA | UUGGCACUCGGCUGUUUCG |
| 2061 | 2062 | 1377-1395 | GAAACAGCCGAGUGCCAAA | UUUGGCACUCGGCUGUUUC |
| 2063 | 2064 | 1378-1396 | AAACAGCCGAGUGCCAAAG | CUUUGGCACUCGGCUGUUU |
| 2065 | 2066 | 1379-1397 | AACAGCCGAGUGCCAAAGU | ACUUUGGCACUCGGCUGUU |
| 2067 | 2068 | 1380-1398 | ACAGCCGAGUGCCAAAGUA | UACUUUGGCACUCGGCUGU |
| 2069 | 2070 | 1381-1399 | CAGCCGAGUGCCAAAGUAC | GUACUUUGGCACUCGGCUG |
| 2071 | 2072 | 1383-1401 | GCCGAGUGCCAAAGUACAU | AUGUACUUUGGCACUCGGC |
| 2073 | 2074 | 1384-1402 | CCGAGUGCCAAAGUACAUC | GAUGUACUUUGGCACUCGG |
| 2075 | 2076 | 1385-1403 | CGAGUGCCAAAGUACAUCU | AGAUGUACUUUGGCACUCG |
| 2077 | 2078 | 1386-1404 | GAGUGCCAAAGUACAUCUU | AAGAUGUACUUUGGCACUC |
| 2079 | 2080 | 1387-1405 | AGUGCCAAAGUACAUCUUC | GAAGAUGUACUUUGGCACU |
| 2081 | 2082 | 1388-1406 | GUGCCAAAGUACAUCUUCC | GGAAGAUGUACUUUGGCAC |
| 2083 | 2084 | 1389-1407 | UGCCAAAGUACAUCUUCCG | CGGAAGAUGUACUUUGGCA |
| 2085 | 2086 | 1390-1408 | GCCAAAGUACAUCUUCCGC | GCGGAAGAUGUACUUUGGC |
| 2087 | 2088 | 1391-1409 | CCAAAGUACAUCUUCCGCC | GGCGGAAGAUGUACUUUGG |
| 2089 | 2090 | 1392-1410 | CAAAGUACAUCUUCCGCCA | UGGCGGAAGAUGUACUUUG |
| 2091 | 2092 | 1393-1411 | AAAGUACAUCUUCCGCCAC | GUGGCGGAAGAUGUACUUU |
| 2093 | 2094 | 1394-1412 | AAGUACAUCUUCCGCCACA | UGUGGCGGAAGAUGUACUU |
| 2095 | 2096 | 1395-1413 | AGUACAUCUUCCGCCACAA | UUGUGGCGGAAGAUGUACU |
| 2097 | 2098 | 1396-1414 | GUACAUCUUCCGCCACAAU | AUUGUGGCGGAAGAUGUAC |
| 2099 | 2100 | 1397-1415 | UACAUCUUCCGCCACAAUG | CAUUGUGGCGGAAGAUGUA |
| 2101 | 2102 | 1398-1416 | ACAUCUUCCGCCACAAUGA | UCAUUGUGGCGGAAGAUGU |
| 2103 | 2104 | 1399-1417 | CAUCUUCCGCCACAAUGAU | AUCAUUGUGGCGGAAGAUG |
| 2105 | 2106 | 1400-1418 | AUCUUCCGCCACAAUGAUG | CAUCAUUGUGGCGGAAGAU |
| 2107 | 2108 | 1401-1419 | UCUUCCGCCACAAUGAUGU | ACAUCAUUGUGGCGGAAGA |
| 2109 | 2110 | 1402-1420 | CUUCCGCCACAAUGAUGUC | GACAUCAUUGUGGCGGAAG |
| 2111 | 2112 | 1403-1421 | UUCCGCCACAAUGAUGUCA | UGACAUCAUUGUGGCGGAA |
| 2113 | 2114 | 1404-1422 | UCCGCCACAAUGAUGUCAG | CUGACAUCAUUGUGGCGGA |
| 2115 | 2116 | 1405-1423 | CCGCCACAAUGAUGUCAGC | GCUGACAUCAUUGUGGCGG |
| 2117 | 2118 | 1406-1424 | CGCCACAAUGAUGUCAGCC | GGCUGACAUCAUUGUGGCG |
| 2119 | 2120 | 1407-1425 | GCCACAAUGAUGUCAGCCA | UGGCUGACAUCAUUGUGGC |
| 2121 | 2122 | 1427-1445 | CUCAGAGAACUGCUGCAAA | UUUGCAGCAGUUCUCUGAG |
| 2123 | 2124 | 1428-1446 | UCAGAGAACUGCUGCAAAG | CUUUGCAGCAGUUCUCUGA |
| 2125 | 2126 | 1429-1447 | CAGAGAACUGCUGCAAAGA | UCUUUGCAGCAGUUCUCUG |

TABLE 9-continued

Human ALAS1 siRNA Sense and Antisense Sequences

| SEQ ID NO: (sense) | SEQ ID NO: (antisense) | Position on transcript NM_000688.4 | Sense Sequence (5'-3') | Antisense Sequence (5'-3') |
|---|---|---|---|---|
| 2127 | 2128 | 1430-1448 | AGAGAACUGCUGCAAAGAU | AUCUUUGCAGCAGUUCUCU |
| 2129 | 2130 | 1431-1449 | GAGAACUGCUGCAAAGAUC | GAUCUUUGCAGCAGUUCUC |
| 2131 | 2132 | 1432-1450 | AGAACUGCUGCAAAGAUCU | AGAUCUUUGCAGCAGUUCU |
| 2133 | 2134 | 1433-1451 | GAACUGCUGCAAAGAUCUG | CAGAUCUUUGCAGCAGUUC |
| 2135 | 2136 | 1434-1452 | AACUGCUGCAAAGAUCUGA | UCAGAUCUUUGCAGCAGUU |
| 2137 | 2138 | 1435-1453 | ACUGCUGCAAAGAUCUGAC | GUCAGAUCUUUGCAGCAGU |
| 2139 | 2140 | 1436-1454 | CUGCUGCAAAGAUCUGACC | GGUCAGAUCUUUGCAGCAG |
| 2141 | 2142 | 1437-1455 | UGCUGCAAAGAUCUGACCC | GGGUCAGAUCUUUGCAGCA |
| 2143 | 2144 | 1457-1475 | UCAGUCCCCAAGAUUGUGG | CCACAAUCUUGGGGACUGA |
| 2145 | 2146 | 1458-1476 | CAGUCCCCAAGAUUGUGGC | GCCACAAUCUUGGGGACUG |
| 2147 | 2148 | 1459-1477 | AGUCCCCAAGAUUGUGGCA | UGCCACAAUCUUGGGGACU |
| 2149 | 2150 | 1461-1479 | UCCCCAAGAUUGUGGCAUU | AAUGCCACAAUCUUGGGGA |
| 2151 | 2152 | 1462-1480 | CCCCAAGAUUGUGGCAUUU | AAAUGCCACAAUCUUGGGG |
| 2153 | 2154 | 1463-1481 | CCCAAGAUUGUGGCAUUUG | CAAAUGCCACAAUCUUGGG |
| 2155 | 2156 | 1464-1482 | CCAAGAUUGUGGCAUUUGA | UCAAAUGCCACAAUCUUGG |
| 2157 | 2158 | 1465-1483 | CAAGAUUGUGGCAUUUGAA | UUCAAAUGCCACAAUCUUG |
| 2159 | 2160 | 1466-1484 | AAGAUUGUGGCAUUUGAAA | UUUCAAAUGCCACAAUCUU |
| 2161 | 2162 | 1467-1485 | AGAUUGUGGCAUUUGAAAC | GUUUCAAAUGCCACAAUCU |
| 2163 | 2164 | 1468-1486 | GAUUGUGGCAUUUGAAACU | AGUUUCAAAUGCCACAAUC |
| 2165 | 2166 | 1469-1487 | AUUGUGGCAUUUGAAACUG | CAGUUUCAAAUGCCACAAU |
| 2167 | 2168 | 1470-1488 | UUGUGGCAUUUGAAACUGU | ACAGUUUCAAAUGCCACAA |
| 2169 | 2170 | 1471-1489 | UGUGGCAUUUGAAACUGUC | GACAGUUUCAAAUGCCACA |
| 2171 | 2172 | 1472-1490 | GUGGCAUUUGAAACUGUCC | GGACAGUUUCAAAUGCCAC |
| 2173 | 2174 | 1473-1491 | UGGCAUUUGAAACUGUCCA | UGGACAGUUUCAAAUGCCA |
| 2175 | 2176 | 1474-1492 | GGCAUUUGAAACUGUCCAU | AUGGACAGUUUCAAAUGCC |
| 2177 | 2178 | 1475-1493 | GCAUUUGAAACUGUCCAUU | AAUGGACAGUUUCAAAUGC |
| 2179 | 2180 | 1476-1494 | CAUUUGAAACUGUCCAUUC | GAAUGGACAGUUUCAAAUG |
| 2181 | 2182 | 1477-1495 | AUUUGAAACUGUCCAUUCA | UGAAUGGACAGUUUCAAAU |
| 2183 | 2184 | 1479-1497 | UUGAAACUGUCCAUUCAAU | AUUGAAUGGACAGUUUCAA |
| 2185 | 2186 | 1480-1498 | UGAAACUGUCCAUUCAAUG | CAUUGAAUGGACAGUUUCA |
| 2187 | 2188 | 1481-1499 | GAAACUGUCCAUUCAAUGG | CCAUUGAAUGGACAGUUUC |
| 2189 | 2190 | 1482-1500 | AAACUGUCCAUUCAAUGGA | UCCAUUGAAUGGACAGUUU |
| 2191 | 2192 | 1483-1501 | AACUGUCCAUUCAAUGGAU | AUCCAUUGAAUGGACAGUU |
| 2193 | 2194 | 1484-1502 | ACUGUCCAUUCAAUGGAUG | CAUCCAUUGAAUGGACAGU |
| 2195 | 2196 | 1485-1503 | CUGUCCAUUCAAUGGAUGG | CCAUCCAUUGAAUGGACAG |
| 2197 | 2198 | 1486-1504 | UGUCCAUUCAAUGGAUGGG | CCCAUCCAUUGAAUGGACA |

TABLE 9-continued

Human ALAS1 siRNA Sense and Antisense Sequences

| SEQ ID NO: (sense) | SEQ ID NO: (anti-sense) | Position on transcript NM_000688.4 | Sense Sequence (5'-3') | Antisense Sequence (5'-3') |
|---|---|---|---|---|
| 2199 | 2200 | 1487-1505 | GUCCAUUCAAUGGAUGGGG | CCCCAUCCAUUGAAUGGAC |
| 2201 | 2202 | 1488-1506 | UCCAUUCAAUGGAUGGGCC | GCCCCAUCCAUUGAAUGGA |
| 2203 | 2204 | 1508-1526 | GUGUGCCCACUGGAAGAGC | GCUCUUCCAGUGGGCACAC |
| 2205 | 2206 | 1509-1527 | UGUGCCCACUGGAAGAGCU | AGCUCUUCCAGUGGGCACA |
| 2207 | 2208 | 1510-1528 | GUGCCCACUGGAAGAGCUG | CAGCUCUUCCAGUGGGCAC |
| 2209 | 2210 | 1511-1529 | UGCCCACUGGAAGAGCUGU | ACAGCUCUUCCAGUGGGCA |
| 2211 | 2212 | 1512-1530 | GCCCACUGGAAGAGCUGUG | CACAGCUCUUCCAGUGGGC |
| 2213 | 2214 | 1513-1531 | CCCACUGGAAGAGCUGUGU | ACACAGCUCUUCCAGUGGG |
| 2215 | 2216 | 1514-1532 | CCACUGGAAGAGCUGUGUG | CACACAGCUCUUCCAGUGG |
| 2217 | 2218 | 1515-1533 | CACUGGAAGAGCUGUGUGA | UCACACAGCUCUUCCAGUG |
| 2219 | 2220 | 1516-1534 | ACUGGAAGAGCUGUGUGAU | AUCACACAGCUCUUCCAGU |
| 2221 | 2222 | 1517-1535 | CUGGAAGAGCUGUGUGAUG | CAUCACACAGCUCUUCCAG |
| 2223 | 2224 | 1518-1536 | UGGAAGAGCUGUGUGAUGU | ACAUCACACAGCUCUUCCA |
| 2225 | 2226 | 1519-1537 | GGAAGAGCUGUGUGAUGUG | CACAUCACACAGCUCUUCC |
| 2227 | 2228 | 1520-1538 | GAAGAGCUGUGUGAUGUGG | CCACAUCACACAGCUCUUC |
| 2229 | 2230 | 1521-1539 | AAGAGCUGUGUGAUGUGGC | GCCACAUCACACAGCUCUU |
| 2231 | 2232 | 1522-1540 | AGAGCUGUGUGAUGUGGCC | GGCCACAUCACACAGCUCU |
| 2233 | 2234 | 1523-1541 | GAGCUGUGUGAUGUGGCCC | GGGCCACAUCACACAGCUC |
| 2235 | 2236 | 1524-1542 | AGCUGUGUGAUGUGGCCCA | UGGGCCACAUCACACAGCU |
| 2237 | 2238 | 1525-1543 | GCUGUGUGAUGUGGCCCAU | AUGGGCCACAUCACACAGC |
| 2239 | 2240 | 1526-1544 | CUGUGUGAUGUGGCCCAUG | CAUGGGCCACAUCACACAG |
| 2241 | 2242 | 1527-1545 | UGUGUGAUGUGGCCCAUGA | UCAUGGGCCACAUCACACA |
| 2243 | 2244 | 1528-1546 | GUGUGAUGUGGCCCAUGAG | CUCAUGGGCCACAUCACAC |
| 2245 | 2246 | 1529-1547 | UGUGAUGUGGCCCAUGAGU | ACUCAUGGGCCACAUCACA |
| 2247 | 2248 | 1532-1550 | GAUGUGGCCCAUGAGUUUG | CAAACUCAUGGGCCACAUC |
| 2249 | 2250 | 1533-1551 | AUGUGGCCCAUGAGUUUGG | CCAAACUCAUGGGCCACAU |
| 2251 | 2252 | 1534-1552 | UGUGGCCCAUGAGUUUGGA | UCCAAACUCAUGGGCCACA |
| 2253 | 2254 | 1535-1553 | GUGGCCCAUGAGUUUGGAG | CUCCAAACUCAUGGGCCAC |
| 2255 | 2256 | 1536-1554 | UGGCCCAUGAGUUUGGAGC | GCUCCAAACUCAUGGGCCA |
| 2257 | 2258 | 1537-1555 | GGCCCAUGAGUUUGGAGCA | UGCUCCAAACUCAUGGGCC |
| 2259 | 2260 | 1538-1556 | GCCCAUGAGUUUGGAGCAA | UUGCUCCAAACUCAUGGGC |
| 2261 | 2262 | 1539-1557 | CCCAUGAGUUUGGAGCAAU | AUUGCUCCAAACUCAUGGG |
| 2263 | 2264 | 1540-1558 | CCAUGAGUUUGGAGCAAUC | GAUUGCUCCAAACUCAUGG |
| 2265 | 2266 | 1542-1560 | AUGAGUUUGGAGCAAUCAC | GUGAUUGCUCCAAACUCAU |
| 2267 | 2268 | 1543-1561 | UGAGUUUGGAGCAAUCACC | GGUGAUUGCUCCAAACUCA |
| 2269 | 2270 | 1545-1563 | AGUUUGGAGCAAUCACCUU | AAGGUGAUUGCUCCAAACU |

TABLE 9-continued

Human ALAS1 siRNA Sense and Antisense Sequences

| SEQ ID NO: (sense) | SEQ ID NO: (anti-sense) | Position on transcript NM_000688.4 | Sense Sequence (5'-3') | Antisense Sequence (5'-3') |
|---|---|---|---|---|
| 2271 | 2272 | 1546-1564 | GUUUGGAGCAAUCACCUUC | GAAGGUGAUUGCUCCAAAC |
| 2273 | 2274 | 1547-1565 | UUUGGAGCAAUCACCUUCG | CGAAGGUGAUUGCUCCAAA |
| 2275 | 2276 | 1548-1566 | UUGGAGCAAUCACCUUCGU | ACGAAGGUGAUUGCUCCAA |
| 2277 | 2278 | 1549-1567 | UGGAGCAAUCACCUUCGUG | CACGAAGGUGAUUGCUCCA |
| 2279 | 2280 | 1550-1568 | GGAGCAAUCACCUUCGUGG | CCACGAAGGUGAUUGCUCC |
| 2281 | 2282 | 1551-1569 | GAGCAAUCACCUUCGUGGA | UCCACGAAGGUGAUUGCUC |
| 2283 | 2284 | 1552-1570 | AGCAAUCACCUUCGUGGAU | AUCCACGAAGGUGAUUGCU |
| 2285 | 2286 | 1553-1571 | GCAAUCACCUUCGUGGAUG | CAUCCACGAAGGUGAUUGC |
| 2287 | 2288 | 1554-1572 | CAAUCACCUUCGUGGAUGA | UCAUCCACGAAGGUGAUUG |
| 2289 | 2290 | 1555-1573 | AAUCACCUUCGUGGAUGAG | CUCAUCCACGAAGGUGAUU |
| 2291 | 2292 | 1556-1574 | AUCACCUUCGUGGAUGAGG | CCUCAUCCACGAAGGUGAU |
| 2293 | 2294 | 1557-1575 | UCACCUUCGUGGAUGAGGU | ACCUCAUCCACGAAGGUGA |
| 2295 | 2296 | 1558-1576 | CACCUUCGUGGAUGAGGUC | GACCUCAUCCACGAAGGUG |
| 2297 | 2298 | 1559-1577 | ACCUUCGUGGAUGAGGUCC | GGACCUCAUCCACGAAGGU |
| 2299 | 2300 | 1560-1578 | CCUUCGUGGAUGAGGUCCA | UGGACCUCAUCCACGAAGG |
| 2301 | 2302 | 1561-1579 | CUUCGUGGAUGAGGUCCAC | GUGGACCUCAUCCACGAAG |
| 2303 | 2304 | 1562-1580 | UUCGUGGAUGAGGUCCACG | CGUGGACCUCAUCCACGAA |
| 2305 | 2306 | 1563-1581 | UCGUGGAUGAGGUCCACGC | GCGUGGACCUCAUCCACGA |
| 2307 | 2308 | 1564-1582 | CGUGGAUGAGGUCCACGCA | UGCGUGGACCUCAUCCACG |
| 2309 | 2310 | 1565-1583 | GUGGAUGAGGUCCACGCAG | CUGCGUGGACCUCAUCCAC |
| 2311 | 2312 | 1566-1584 | UGGAUGAGGUCCACGCAGU | ACUGCGUGGACCUCAUCCA |
| 2313 | 2314 | 1567-1585 | GGAUGAGGUCCACGCAGUG | CACUGCGUGGACCUCAUCC |
| 2315 | 2316 | 1568-1586 | GAUGAGGUCCACGCAGUGG | CCACUGCGUGGACCUCAUC |
| 2317 | 2318 | 1569-1587 | AUGAGGUCCACGCAGUGGG | CCCACUGCGUGGACCUCAU |
| 2319 | 2320 | 1570-1588 | UGAGGUCCACGCAGUGGGG | CCCCACUGCGUGGACCUCA |
| 2321 | 2322 | 1571-1589 | GAGGUCCACGCAGUGGGGC | GCCCCACUGCGUGGACCUC |
| 2323 | 2324 | 1572-1590 | AGGUCCACGCAGUGGGGCU | AGCCCCACUGCGUGGACCU |
| 2325 | 2326 | 1595-1613 | GGGGCUCGAGGCGGAGGGA | UCCCUCCGCCUCGAGCCCC |
| 2327 | 2328 | 1596-1614 | GGGCUCGAGGCGGAGGGAU | AUCCCUCCGCCUCGAGCCC |
| 2329 | 2330 | 1597-1615 | GGCUCGAGGCGGAGGGAUU | AAUCCCUCCGCCUCGAGCC |
| 2331 | 2332 | 1598-1616 | GCUCGAGGCGGAGGGAUUG | CAAUCCCUCCGCCUCGAGC |
| 2333 | 2334 | 1599-1617 | CUCGAGGCGGAGGGAUUGG | CCAAUCCCUCCGCCUCGAG |
| 2335 | 2336 | 1600-1618 | UCGAGGCGGAGGGAUUGGG | CCCAAUCCCUCCGCCUCGA |
| 2337 | 2338 | 1601-1619 | CGAGGCGGAGGGAUUGGGG | CCCCAAUCCCUCCGCCUCG |
| 2339 | 2340 | 1602-1620 | GAGGCGGAGGGAUUGGGGA | UCCCCAAUCCCUCCGCCUC |
| 2341 | 2342 | 1603-1621 | AGGCGGAGGGAUUGGGGAU | AUCCCCAAUCCCUCCGCCU |

TABLE 9-continued

Human ALAS1 siRNA Sense and Antisense Sequences

| SEQ ID NO: (sense) | SEQ ID NO: (antisense) | Position on transcript NM_000688.4 | Sense Sequence (5'-3') | Antisense Sequence (5'-3') |
|---|---|---|---|---|
| 2343 | 2344 | 1604-1622 | GGCGGAGGGAUUGGGGAUC | GAUCCCCAAUCCCUCCGCC |
| 2345 | 2346 | 1605-1623 | GCGGAGGGAUUGGGGAUCG | CGAUCCCCAAUCCCUCCGC |
| 2347 | 2348 | 1606-1624 | CGGAGGGAUUGGGGAUCGG | CCGAUCCCCAAUCCCUCCG |
| 2349 | 2350 | 1607-1625 | GGAGGGAUUGGGGAUCGGG | CCCGAUCCCCAAUCCCUCC |
| 2351 | 2352 | 1608-1626 | GAGGGAUUGGGGAUCGGGA | UCCCGAUCCCCAAUCCCUC |
| 2353 | 2354 | 1609-1627 | AGGGAUUGGGGAUCGGGAU | AUCCCGAUCCCCAAUCCCU |
| 2355 | 2356 | 1610-1628 | GGGAUUGGGGAUCGGGAUG | CAUCCCGAUCCCCAAUCCC |
| 2357 | 2358 | 1611-1629 | GGAUUGGGGAUCGGGAUGG | CCAUCCCGAUCCCCAAUCC |
| 2359 | 2360 | 1612-1630 | GAUUGGGGAUCGGGAUGGA | UCCAUCCCGAUCCCCAAUC |
| 2361 | 2362 | 1613-1631 | AUUGGGGAUCGGGAUGGAG | CUCCAUCCCGAUCCCCAAU |
| 2363 | 2364 | 1614-1632 | UUGGGGAUCGGGAUGGAGU | ACUCCAUCCCGAUCCCCAA |
| 2365 | 2366 | 1615-1633 | UGGGGAUCGGGAUGGAGUC | GACUCCAUCCCGAUCCCCA |
| 2367 | 2368 | 1617-1635 | GGGAUCGGGAUGGAGUCAU | AUGACUCCAUCCCGAUCCC |
| 2369 | 2370 | 1618-1636 | GGAUCGGGAUGGAGUCAUG | CAUGACUCCAUCCCGAUCC |
| 2371 | 2372 | 1619-1637 | GAUCGGGAUGGAGUCAUGC | GCAUGACUCCAUCCCGAUC |
| 2373 | 2374 | 1620-1638 | AUCGGGAUGGAGUCAUGCC | GGCAUGACUCCAUCCCGAU |
| 2375 | 2376 | 1621-1639 | UCGGGAUGGAGUCAUGCCA | UGGCAUGACUCCAUCCCGA |
| 2377 | 2378 | 1622-1640 | CGGGAUGGAGUCAUGCCAA | UUGGCAUGACUCCAUCCCG |
| 2379 | 2380 | 1623-1641 | GGGAUGGAGUCAUGCCAAA | UUUGGCAUGACUCCAUCCC |
| 2381 | 2382 | 1624-1642 | GGAUGGAGUCAUGCCAAAA | UUUUGGCAUGACUCCAUCC |
| 2383 | 2384 | 1625-1643 | GAUGGAGUCAUGCCAAAAA | UUUUUGGCAUGACUCCAUC |
| 2385 | 2386 | 1626-1644 | AUGGAGUCAUGCCAAAAAU | AUUUUUGGCAUGACUCCAU |
| 2387 | 2388 | 1627-1645 | UGGAGUCAUGCCAAAAAUG | CAUUUUUGGCAUGACUCCA |
| 2389 | 2390 | 1628-1646 | GGAGUCAUGCCAAAAAUGG | CCAUUUUUGGCAUGACUCC |
| 2391 | 2392 | 1629-1647 | GAGUCAUGCCAAAAAUGGA | UCCAUUUUUGGCAUGACUC |
| 2393 | 2394 | 1630-1648 | AGUCAUGCCAAAAAUGGAC | GUCCAUUUUUGGCAUGACU |
| 2395 | 2396 | 1632-1650 | UCAUGCCAAAAAUGGACAU | AUGUCCAUUUUUGGCAUGA |
| 2397 | 2398 | 1633-1651 | CAUGCCAAAAAUGGACAUC | GAUGUCCAUUUUUGGCAUG |
| 2399 | 2400 | 1636-1654 | GCCAAAAAUGGACAUCAUU | AAUGAUGUCCAUUUUUGGC |
| 2401 | 2402 | 1638-1656 | CAAAAAUGGACAUCAUUUC | GAAAUGAUGUCCAUUUUUG |
| 2403 | 2404 | 1639-1657 | AAAAAUGGACAUCAUUUCU | AGAAAUGAUGUCCAUUUUU |
| 2405 | 2406 | 1640-1658 | AAAAUGGACAUCAUUUCUG | CAGAAAUGAUGUCCAUUUU |
| 2407 | 2408 | 1641-1659 | AAAUGGACAUCAUUUCUGG | CCAGAAAUGAUGUCCAUUU |
| 2409 | 2410 | 1642-1660 | AAUGGACAUCAUUUCUGGA | UCCAGAAAUGAUGUCCAUU |
| 2411 | 2412 | 1643-1661 | AUGGACAUCAUUUCUGGAA | UUCCAGAAAUGAUGUCCAU |
| 2413 | 2414 | 1644-1662 | UGGACAUCAUUUCUGGAAC | GUUCCAGAAAUGAUGUCCA |

TABLE 9-continued

Human ALAS1 siRNA Sense and Antisense Sequences

| SEQ ID NO: (sense) | SEQ ID NO: (anti-sense) | Position on transcript NM_000688.4 | Sense Sequence (5'-3') | Antisense Sequence (5'-3') |
|---|---|---|---|---|
| 2415 | 2416 | 1645-1663 | GGACAUCAUUUCUGGAACA | UGUUCCAGAAAUGAUGUCC |
| 2417 | 2418 | 1646-1664 | GACAUCAUUUCUGGAACAC | GUGUUCCAGAAAUGAUGUC |
| 2419 | 2420 | 1647-1665 | ACAUCAUUUCUGGAACACU | AGUGUUCCAGAAAUGAUGU |
| 2421 | 2422 | 1648-1666 | CAUCAUUUCUGGAACACUU | AAGUGUUCCAGAAAUGAUG |
| 2423 | 2424 | 1649-1667 | AUCAUUUCUGGAACACUUG | CAAGUGUUCCAGAAAUGAU |
| 2425 | 2426 | 1650-1668 | UCAUUUCUGGAACACUUGG | CCAAGUGUUCCAGAAAUGA |
| 2427 | 2428 | 1651-1669 | CAUUUCUGGAACACUUGGC | GCCAAGUGUUCCAGAAAUG |
| 2429 | 2430 | 1652-1670 | AUUUCUGGAACACUUGGCA | UGCCAAGUGUUCCAGAAAU |
| 2431 | 2432 | 1653-1671 | UUUCUGGAACACUUGGCAA | UUGCCAAGUGUUCCAGAAA |
| 2433 | 2434 | 1654-1672 | UUCUGGAACACUUGGCAAA | UUUGCCAAGUGUUCCAGAA |
| 2435 | 2436 | 1655-1673 | UCUGGAACACUUGGCAAAG | CUUUGCCAAGUGUUCCAGA |
| 2437 | 2438 | 1656-1674 | CUGGAACACUUGGCAAAGC | GCUUUGCCAAGUGUUCCAG |
| 2439 | 2440 | 1657-1675 | UGGAACACUUGGCAAAGCC | GGCUUUGCCAAGUGUUCCA |
| 2441 | 2442 | 1658-1676 | GGAACACUUGGCAAAGCCU | AGGCUUUGCCAAGUGUUCC |
| 2443 | 2444 | 1659-1677 | GAACACUUGGCAAAGCCUU | AAGGCUUUGCCAAGUGUUC |
| 2445 | 2446 | 1660-1678 | AACACUUGGCAAAGCCUUU | AAAGGCUUUGCCAAGUGUU |
| 2447 | 2448 | 1661-1679 | ACACUUGGCAAAGCCUUUG | CAAAGGCUUUGCCAAGUGU |
| 2449 | 2450 | 1662-1680 | CACUUGGCAAAGCCUUUGG | CCAAAGGCUUUGCCAAGUG |
| 2451 | 2452 | 1682-1700 | UGUGUUGGAGGGUACAUCG | CGAUGUACCCUCCAACACA |
| 2453 | 2454 | 1683-1701 | GUGUUGGAGGGUACAUCGC | GCGAUGUACCCUCCAACAC |
| 2455 | 2456 | 1684-1702 | UGUUGGAGGGUACAUCGCC | GGCGAUGUACCCUCCAACA |
| 2457 | 2458 | 1685-1703 | GUUGGAGGGUACAUCGCCA | UGGCGAUGUACCCUCCAAC |
| 2459 | 2460 | 1686-1704 | UUGGAGGGUACAUCGCCAG | CUGGCGAUGUACCCUCCAA |
| 2461 | 2462 | 1687-1705 | UGGAGGGUACAUCGCCAGC | GCUGGCGAUGUACCCUCCA |
| 2463 | 2464 | 1688-1706 | GGAGGGUACAUCGCCAGCA | UGCUGGCGAUGUACCCUCC |
| 2465 | 2466 | 1689-1707 | GAGGGUACAUCGCCAGCAC | GUGCUGGCGAUGUACCCUC |
| 2467 | 2468 | 1690-1708 | AGGGUACAUCGCCAGCACG | CGUGCUGGCGAUGUACCCU |
| 2469 | 2470 | 1691-1709 | GGGUACAUCGCCAGCACGA | UCGUGCUGGCGAUGUACCC |
| 2471 | 2472 | 1692-1710 | GGUACAUCGCCAGCACGAG | CUCGUGCUGGCGAUGUACC |
| 2473 | 2474 | 1693-1711 | GUACAUCGCCAGCACGAGU | ACUCGUGCUGGCGAUGUAC |
| 2475 | 2476 | 1694-1712 | UACAUCGCCAGCACGAGUU | AACUCGUGCUGGCGAUGUA |
| 2477 | 2478 | 1695-1713 | ACAUCGCCAGCACGAGUUC | GAACUCGUGCUGGCGAUGU |
| 2479 | 2480 | 1696-1714 | CAUCGCCAGCACGAGUUCU | AGAACUCGUGCUGGCGAUG |
| 2481 | 2482 | 1697-1715 | AUCGCCAGCACGAGUUCUC | GAGAACUCGUGCUGGCGAU |
| 2483 | 2484 | 1698-1716 | UCGCCAGCACGAGUUCUCU | AGAGAACUCGUGCUGGCGA |
| 2485 | 2486 | 1699-1717 | CGCCAGCACGAGUUCUCUG | CAGAGAACUCGUGCUGGCG |

TABLE 9-continued

Human ALAS1 siRNA Sense and Antisense Sequences

| SEQ ID NO: (sense) | SEQ ID NO: (antisense) | Position on transcript NM_000688.4 | Sense Sequence (5'-3') | Antisense Sequence (5'-3') |
|---|---|---|---|---|
| 2487 | 2488 | 1700-1718 | GCCAGCACGAGUUCUCUGA | UCAGAGAACUCGUGCUGGC |
| 2489 | 2490 | 1701-1719 | CCAGCACGAGUUCUCUGAU | AUCAGAGAACUCGUGCUGG |
| 2491 | 2492 | 1702-1720 | CAGCACGAGUUCUCUGAUU | AAUCAGAGAACUCGUGCUG |
| 2493 | 2494 | 1703-1721 | AGCACGAGUUCUCUGAUUG | CAAUCAGAGAACUCGUGCU |
| 2495 | 2496 | 1704-1722 | GCACGAGUUCUCUGAUUGA | UCAAUCAGAGAACUCGUGC |
| 2497 | 2498 | 1705-1723 | CACGAGUUCUCUGAUUGAC | GUCAAUCAGAGAACUCGUG |
| 2499 | 2500 | 1707-1725 | CGAGUUCUCUGAUUGACAC | GUGUCAAUCAGAGAACUCG |
| 2501 | 2502 | 1727-1745 | GUACGGUCCUAUGCUGCUG | CAGCAGCAUAGGACCGUAC |
| 2503 | 2504 | 1728-1746 | UACGGUCCUAUGCUGCUGG | CCAGCAGCAUAGGACCGUA |
| 2505 | 2506 | 1729-1747 | ACGGUCCUAUGCUGCUGGC | GCCAGCAGCAUAGGACCGU |
| 2507 | 2508 | 1730-1748 | CGGUCCUAUGCUGCUGGCU | AGCCAGCAGCAUAGGACCG |
| 2509 | 2510 | 1731-1749 | GGUCCUAUGCUGCUGGCUU | AAGCCAGCAGCAUAGGACC |
| 2511 | 2512 | 1732-1750 | GUCCUAUGCUGCUGGCUUC | GAAGCCAGCAGCAUAGGAC |
| 2513 | 2514 | 1733-1751 | UCCUAUGCUGCUGGCUUCA | UGAAGCCAGCAGCAUAGGA |
| 2515 | 2516 | 1734-1752 | CCUAUGCUGCUGGCUUCAU | AUGAAGCCAGCAGCAUAGG |
| 2517 | 2518 | 1735-1753 | CUAUGCUGCUGGCUUCAUC | GAUGAAGCCAGCAGCAUAG |
| 2519 | 2520 | 1736-1754 | UAUGCUGCUGGCUUCAUCU | AGAUGAAGCCAGCAGCAUA |
| 2521 | 2522 | 1737-1755 | AUGCUGCUGGCUUCAUCUU | AAGAUGAAGCCAGCAGCAU |
| 2523 | 2524 | 1738-1756 | UGCUGCUGGCUUCAUCUUC | GAAGAUGAAGCCAGCAGCA |
| 2525 | 2526 | 1739-1757 | GCUGCUGGCUUCAUCUUCA | UGAAGAUGAAGCCAGCAGC |
| 2527 | 2528 | 1740-1758 | CUGCUGGCUUCAUCUUCAC | GUGAAGAUGAAGCCAGCAG |
| 2529 | 2530 | 1741-1759 | UGCUGGCUUCAUCUUCACC | GGUGAAGAUGAAGCCAGCA |
| 2531 | 2532 | 1742-1760 | GCUGGCUUCAUCUUCACCA | UGGUGAAGAUGAAGCCAGC |
| 2533 | 2534 | 1743-1761 | CUGGCUUCAUCUUCACCAC | GUGGUGAAGAUGAAGCCAG |
| 2535 | 2536 | 1744-1762 | UGGCUUCAUCUUCACCACC | GGUGGUGAAGAUGAAGCCA |
| 2537 | 2538 | 1745-1763 | GGCUUCAUCUUCACCACCU | AGGUGGUGAAGAUGAAGCC |
| 2539 | 2540 | 1746-1764 | GCUUCAUCUUCACCACCUC | GAGGUGGUGAAGAUGAAGC |
| 2541 | 2542 | 1747-1765 | CUUCAUCUUCACCACCUCU | AGAGGUGGUGAAGAUGAAG |
| 2543 | 2544 | 1748-1766 | UUCAUCUUCACCACCUCUC | GAGAGGUGGUGAAGAUGAA |
| 2545 | 2546 | 1749-1767 | UCAUCUUCACCACCUCUCU | AGAGAGGUGGUGAAGAUGA |
| 2547 | 2548 | 1750-1768 | CAUCUUCACCACCUCUCUG | CAGAGAGGUGGUGAAGAUG |
| 2549 | 2550 | 1751-1769 | AUCUUCACCACCUCUCUGC | GCAGAGAGGUGGUGAAGAU |
| 2551 | 2552 | 1752-1770 | UCUUCACCACCUCUCUGCC | GGCAGAGAGGUGGUGAAGA |
| 2553 | 2554 | 1753-1771 | CUUCACCACCUCUCUGCCA | UGGCAGAGAGGUGGUGAAG |
| 2555 | 2556 | 1754-1772 | UUCACCACCUCUCUGCCAC | GUGGCAGAGAGGUGGUGAA |
| 2557 | 2558 | 1755-1773 | UCACCACCUCUCUGCCACC | GGUGGCAGAGAGGUGGUGA |

TABLE 9-continued

Human ALAS1 siRNA Sense and Antisense Sequences

| SEQ ID NO: (sense) | SEQ ID NO: (antisense) | Position on transcript NM_000688.4 | Sense Sequence (5'-3') | Antisense Sequence (5'-3') |
|---|---|---|---|---|
| 2559 | 2560 | 1756-1774 | CACCACCUCUCUGCCACCC | GGGUGGCAGAGAGGUGGUG |
| 2561 | 2562 | 1757-1775 | ACCACCUCUCUGCCACCCA | UGGGUGGCAGAGAGGUGGU |
| 2563 | 2564 | 1758-1776 | CCACCUCUCUGCCACCCAU | AUGGGUGGCAGAGAGGUGG |
| 2565 | 2566 | 1759-1777 | CACCUCUCUGCCACCCAUG | CAUGGGUGGCAGAGAGGUG |
| 2567 | 2568 | 1760-1778 | ACCUCUCUGCCACCCAUGC | GCAUGGGUGGCAGAGAGGU |
| 2569 | 2570 | 1761-1779 | CCUCUCUGCCACCCAUGCU | AGCAUGGGUGGCAGAGAGG |
| 2571 | 2572 | 1762-1780 | CUCUCUGCCACCCAUGCUG | CAGCAUGGGUGGCAGAGAG |
| 2573 | 2574 | 1763-1781 | UCUCUGCCACCCAUGCUGC | GCAGCAUGGGUGGCAGAGA |
| 2575 | 2576 | 1764-1782 | CUCUGCCACCCAUGCUGCU | AGCAGCAUGGGUGGCAGAG |
| 2577 | 2578 | 1765-1783 | UCUGCCACCCAUGCUGCUG | CAGCAGCAUGGGUGGCAGA |
| 2579 | 2580 | 1766-1784 | CUGCCACCCAUGCUGCUGG | CCAGCAGCAUGGGUGGCAG |
| 2581 | 2582 | 1767-1785 | UGCCACCCAUGCUGCUGGC | GCCAGCAGCAUGGGUGGCA |
| 2583 | 2584 | 1768-1786 | GCCACCCAUGCUGCUGGCU | AGCCAGCAGCAUGGGUGGC |
| 2585 | 2586 | 1769-1787 | CCACCCAUGCUGCUGGCUG | CAGCCAGCAGCAUGGGUGG |
| 2587 | 2588 | 1770-1788 | CACCCAUGCUGCUGGCUGG | CCAGCCAGCAGCAUGGGUG |
| 2589 | 2590 | 1771-1789 | ACCCAUGCUGCUGGCUGGA | UCCAGCCAGCAGCAUGGGU |
| 2591 | 2592 | 1772-1790 | CCCAUGCUGCUGGCUGGAG | CUCCAGCCAGCAGCAUGGG |
| 2593 | 2594 | 1773-1791 | CCAUGCUGCUGGCUGGAGC | GCUCCAGCCAGCAGCAUGG |
| 2595 | 2596 | 1774-1792 | CAUGCUGCUGGCUGGAGCC | GGCUCCAGCCAGCAGCAUG |
| 2597 | 2598 | 1775-1793 | AUGCUGCUGGCUGGAGCCC | GGGCUCCAGCCAGCAGCAU |
| 2599 | 2600 | 1776-1794 | UGCUGCUGGCUGGAGCCCU | AGGGCUCCAGCCAGCAGCA |
| 2601 | 2602 | 1777-1795 | GCUGCUGGCUGGAGCCCUG | CAGGGCUCCAGCCAGCAGC |
| 2603 | 2604 | 1778-1796 | CUGCUGGCUGGAGCCCUGG | CCAGGGCUCCAGCCAGCAG |
| 2605 | 2606 | 1779-1797 | UGCUGGCUGGAGCCCUGGA | UCCAGGGCUCCAGCCAGCA |
| 2607 | 2608 | 1780-1798 | GCUGGCUGGAGCCCUGGAG | CUCCAGGGCUCCAGCCAGC |
| 2609 | 2610 | 1781-1799 | CUGGCUGGAGCCCUGGAGU | ACUCCAGGGCUCCAGCCAG |
| 2611 | 2612 | 1782-1800 | UGGCUGGAGCCCUGGAGUC | GACUCCAGGGCUCCAGCCA |
| 2613 | 2614 | 1783-1801 | GGCUGGAGCCCUGGAGUCU | AGACUCCAGGGCUCCAGCC |
| 2615 | 2616 | 1784-1802 | GCUGGAGCCCUGGAGUCUG | CAGACUCCAGGGCUCCAGC |
| 2617 | 2618 | 1785-1803 | CUGGAGCCCUGGAGUCUGU | ACAGACUCCAGGGCUCCAG |
| 2619 | 2620 | 1786-1804 | UGGAGCCCUGGAGUCUGUG | CACAGACUCCAGGGCUCCA |
| 2621 | 2622 | 1787-1805 | GGAGCCCUGGAGUCUGUGC | GCACAGACUCCAGGGCUCC |
| 2623 | 2624 | 1788-1806 | GAGCCCUGGAGUCUGUGCG | CGCACAGACUCCAGGGCUC |
| 2625 | 2626 | 1789-1807 | AGCCCUGGAGUCUGUGCGG | CCGCACAGACUCCAGGGCU |
| 2627 | 2628 | 1790-1808 | GCCCUGGAGUCUGUGCGGA | UCCGCACAGACUCCAGGGC |
| 2629 | 2630 | 1792-1810 | CCUGGAGUCUGUGCGGAUC | GAUCCGCACAGACUCCAGG |

TABLE 9-continued

Human ALAS1 siRNA Sense and Antisense Sequences

| SEQ ID NO: (sense) | SEQ ID NO: (antisense) | Position on transcript NM_000688.4 | Sense Sequence (5'-3') | Antisense Sequence (5'-3') |
|---|---|---|---|---|
| 2631 | 2632 | 1793-1811 | CUGGAGUCUGUGCGGAUCC | GGAUCCGCACAGACUCCAG |
| 2633 | 2634 | 1795-1813 | GGAGUCUGUGCGGAUCCUG | CAGGAUCCGCACAGACUCC |
| 2635 | 2636 | 1796-1814 | GAGUCUGUGCGGAUCCUGA | UCAGGAUCCGCACAGACUC |
| 2637 | 2638 | 1797-1815 | AGUCUGUGCGGAUCCUGAA | UUCAGGAUCCGCACAGACU |
| 2639 | 2640 | 1798-1816 | GUCUGUGCGGAUCCUGAAG | CUUCAGGAUCCGCACAGAC |
| 2641 | 2642 | 1799-1817 | UCUGUGCGGAUCCUGAAGA | UCUUCAGGAUCCGCACAGA |
| 2643 | 2644 | 1800-1818 | CUGUGCGGAUCCUGAAGAG | CUCUUCAGGAUCCGCACAG |
| 2645 | 2646 | 1801-1819 | UGUGCGGAUCCUGAAGAGC | GCUCUUCAGGAUCCGCACA |
| 2647 | 2648 | 1802-1820 | GUGCGGAUCCUGAAGAGCG | CGCUCUUCAGGAUCCGCAC |
| 2649 | 2650 | 1803-1821 | UGCGGAUCCUGAAGAGCGC | GCGCUCUUCAGGAUCCGCA |
| 2651 | 2652 | 1804-1822 | GCGGAUCCUGAAGAGCGCU | AGCGCUCUUCAGGAUCCGC |
| 2653 | 2654 | 1805-1823 | CGGAUCCUGAAGAGCGCUG | CAGCGCUCUUCAGGAUCCG |
| 2655 | 2656 | 1806-1824 | GGAUCCUGAAGAGCGCUGA | UCAGCGCUCUUCAGGAUCC |
| 2657 | 2658 | 1807-1825 | GAUCCUGAAGAGCGCUGAG | CUCAGCGCUCUUCAGGAUC |
| 2659 | 2660 | 1808-1826 | AUCCUGAAGAGCGCUGAGG | CCUCAGCGCUCUUCAGGAU |
| 2661 | 2662 | 1809-1827 | UCCUGAAGAGCGCUGAGGG | CCCUCAGCGCUCUUCAGGA |
| 2663 | 2664 | 1810-1828 | CCUGAAGAGCGCUGAGGGA | UCCCUCAGCGCUCUUCAGG |
| 2665 | 2666 | 1811-1829 | CUGAAGAGCGCUGAGGGAC | GUCCCUCAGCGCUCUUCAG |
| 2667 | 2668 | 1812-1830 | UGAAGAGCGCUGAGGGACG | CGUCCCUCAGCGCUCUUCA |
| 2669 | 2670 | 1813-1831 | GAAGAGCGCUGAGGGACGG | CCGUCCCUCAGCGCUCUUC |
| 2671 | 2672 | 1814-1832 | AAGAGCGCUGAGGGACGGG | CCCGUCCCUCAGCGCUCUU |
| 2673 | 2674 | 1815-1833 | AGAGCGCUGAGGGACGGGU | ACCCGUCCCUCAGCGCUCU |
| 2675 | 2676 | 1816-1834 | GAGCGCUGAGGGACGGGUG | CACCCGUCCCUCAGCGCUC |
| 2677 | 2678 | 1817-1835 | AGCGCUGAGGGACGGGUGC | GCACCCGUCCCUCAGCGCU |
| 2679 | 2680 | 1818-1836 | GCGCUGAGGGACGGGUGCU | AGCACCCGUCCCUCAGCGC |
| 2681 | 2682 | 1819-1837 | CGCUGAGGGACGGGUGCUU | AAGCACCCGUCCCUCAGCG |
| 2683 | 2684 | 1820-1838 | GCUGAGGGACGGGUGCUUC | GAAGCACCCGUCCCUCAGC |
| 2685 | 2686 | 1821-1839 | CUGAGGGACGGGUGCUUCG | CGAAGCACCCGUCCCUCAG |
| 2687 | 2688 | 1822-1840 | UGAGGGACGGGUGCUUCGC | GCGAAGCACCCGUCCCUCA |
| 2689 | 2690 | 1823-1841 | GAGGGACGGGUGCUUCGCC | GGCGAAGCACCCGUCCCUC |
| 2691 | 2692 | 1824-1842 | AGGGACGGGUGCUUCGCCG | CGGCGAAGCACCCGUCCCU |
| 2693 | 2694 | 1825-1843 | GGGACGGGUGCUUCGCCGC | GCGGCGAAGCACCCGUCCC |
| 2695 | 2696 | 1826-1844 | GGACGGGUGCUUCGCCGCC | GGCGGCGAAGCACCCGUCC |
| 2697 | 2698 | 1827-1845 | GACGGGUGCUUCGCCGCCA | UGGCGGCGAAGCACCCGUC |
| 2699 | 2700 | 1828-1846 | ACGGGUGCUUCGCCGCCAG | CUGGCGGCGAAGCACCCGU |
| 2701 | 2702 | 1829-1847 | CGGGUGCUUCGCCGCCAGC | GCUGGCGGCGAAGCACCCG |

TABLE 9-continued

Human ALAS1 siRNA Sense and Antisense Sequences

| SEQ ID NO: (sense) | SEQ ID NO: (antisense) | Position on transcript NM_000688.4 | Sense Sequence (5'-3') | Antisense Sequence (5'-3') |
|---|---|---|---|---|
| 2703 | 2704 | 1830-1848 | GGGUGCUUCGCCGCCAGCA | UGCUGGCGGCGAAGCACCC |
| 2705 | 2706 | 1831-1849 | GGUGCUUCGCCGCCAGCAC | GUGCUGGCGGCGAAGCACC |
| 2707 | 2708 | 1832-1850 | GUGCUUCGCCGCCAGCACC | GGUGCUGGCGGCGAAGCAC |
| 2709 | 2710 | 1833-1851 | UGCUUCGCCGCCAGCACCA | UGGUGCUGGCGGCGAAGCA |
| 2711 | 2712 | 1834-1852 | GCUUCGCCGCCAGCACCAG | CUGGUGCUGGCGGCGAAGC |
| 2713 | 2714 | 1835-1853 | CUUCGCCGCCAGCACCAGC | GCUGGUGCUGGCGGCGAAG |
| 2715 | 2716 | 1836-1854 | UUCGCCGCCAGCACCAGCG | CGCUGGUGCUGGCGGCGAA |
| 2717 | 2718 | 1837-1855 | UCGCCGCCAGCACCAGCGC | GCGCUGGUGCUGGCGGCGA |
| 2719 | 2720 | 1838-1856 | CGCCGCCAGCACCAGCGCA | UGCGCUGGUGCUGGCGGCG |
| 2721 | 2722 | 1839-1857 | GCCGCCAGCACCAGCGCAA | UUGCGCUGGUGCUGGCGGC |
| 2723 | 2724 | 1840-1858 | CCGCCAGCACCAGCGCAAC | GUUGCGCUGGUGCUGGCGG |
| 2725 | 2726 | 1841-1859 | CGCCAGCACCAGCGCAACG | CGUUGCGCUGGUGCUGGCG |
| 2727 | 2728 | 1842-1860 | GCCAGCACCAGCGCAACGU | ACGUUGCGCUGGUGCUGGC |
| 2729 | 2730 | 1865-1883 | CUCAUGAGACAGAUGCUAA | UUAGCAUCUGUCUCAUGAG |
| 2731 | 2732 | 1866-1884 | UCAUGAGACAGAUGCUAAU | AUUAGCAUCUGUCUCAUGA |
| 2733 | 2734 | 1867-1885 | CAUGAGACAGAUGCUAAUG | CAUUAGCAUCUGUCUCAUG |
| 2735 | 2736 | 1868-1886 | AUGAGACAGAUGCUAAUGG | CCAUUAGCAUCUGUCUCAU |
| 2737 | 2738 | 1869-1887 | UGAGACAGAUGCUAAUGGA | UCCAUUAGCAUCUGUCUCA |
| 2739 | 2740 | 1871-1889 | AGACAGAUGCUAAUGGAUG | CAUCCAUUAGCAUCUGUCU |
| 2741 | 2742 | 1872-1890 | GACAGAUGCUAAUGGAUGC | GCAUCCAUUAGCAUCUGUC |
| 2743 | 2744 | 1873-1891 | ACAGAUGCUAAUGGAUGCC | GGCAUCCAUUAGCAUCUGU |
| 2745 | 2746 | 1874-1892 | CAGAUGCUAAUGGAUGCCG | CGGCAUCCAUUAGCAUCUG |
| 2747 | 2748 | 1875-1893 | AGAUGCUAAUGGAUGCCGG | CCGGCAUCCAUUAGCAUCU |
| 2749 | 2750 | 1876-1894 | GAUGCUAAUGGAUGCCGGC | GCCGGCAUCCAUUAGCAUC |
| 2751 | 2752 | 1877-1895 | AUGCUAAUGGAUGCCGGCC | GGCCGGCAUCCAUUAGCAU |
| 2753 | 2754 | 1878-1896 | UGCUAAUGGAUGCCGGCCU | AGGCCGGCAUCCAUUAGCA |
| 2755 | 2756 | 1879-1897 | GCUAAUGGAUGCCGGCCUC | GAGGCCGGCAUCCAUUAGC |
| 2757 | 2758 | 1880-1898 | CUAAUGGAUGCCGGCCUCC | GGAGGCCGGCAUCCAUUAG |
| 2759 | 2760 | 1881-1899 | UAAUGGAUGCCGGCCUCCC | GGGAGGCCGGCAUCCAUUA |
| 2761 | 2762 | 1882-1900 | AAUGGAUGCCGGCCUCCCU | AGGGAGGCCGGCAUCCAUU |
| 2763 | 2764 | 1883-1901 | AUGGAUGCCGGCCUCCCUG | CAGGGAGGCCGGCAUCCAU |
| 2765 | 2766 | 1884-1902 | UGGAUGCCGGCCUCCCUGU | ACAGGGAGGCCGGCAUCCA |
| 2767 | 2768 | 1885-1903 | GGAUGCCGGCCUCCCUGUU | AACAGGGAGGCCGGCAUCC |
| 2769 | 2770 | 1886-1904 | GAUGCCGGCCUCCCUGUUG | CAACAGGGAGGCCGGCAUC |
| 2771 | 2772 | 1887-1905 | AUGCCGGCCUCCCUGUUGU | ACAACAGGGAGGCCGGCAU |
| 2773 | 2774 | 1888-1906 | UGCCGGCCUCCCUGUUGUC | GACAACAGGGAGGCCGGCA |

TABLE 9-continued

Human ALAS1 siRNA Sense and Antisense Sequences

| SEQ ID NO: (sense) | SEQ ID NO: (antisense) | Position on transcript NM_000688.4 | Sense Sequence (5'-3') | Antisense Sequence (5'-3') |
|---|---|---|---|---|
| 2775 | 2776 | 1889-1907 | GCCGGCCUCCCUGUUGUCC | GGACAACAGGGAGGCCGGC |
| 2777 | 2778 | 1890-1908 | CCGGCCUCCCUGUUGUCCA | UGGACAACAGGGAGGCCGG |
| 2779 | 2780 | 1891-1909 | CGGCCUCCCUGUUGUCCAC | GUGGACAACAGGGAGGCCG |
| 2781 | 2782 | 1892-1910 | GGCCUCCCUGUUGUCCACU | AGUGGACAACAGGGAGGCC |
| 2783 | 2784 | 1893-1911 | GCCUCCCUGUUGUCCACUG | CAGUGGACAACAGGGAGGC |
| 2785 | 2786 | 1894-1912 | CCUCCCUGUUGUCCACUGC | GCAGUGGACAACAGGGAGG |
| 2787 | 2788 | 1895-1913 | CUCCCUGUUGUCCACUGCC | GGCAGUGGACAACAGGGAG |
| 2789 | 2790 | 1896-1914 | UCCCUGUUGUCCACUGCCC | GGGCAGUGGACAACAGGGA |
| 2791 | 2792 | 1897-1915 | CCCUGUUGUCCACUGCCCC | GGGGCAGUGGACAACAGGG |
| 2793 | 2794 | 1898-1916 | CCUGUUGUCCACUGCCCCA | UGGGGCAGUGGACAACAGG |
| 2795 | 2796 | 1899-1917 | CUGUUGUCCACUGCCCCAG | CUGGGGCAGUGGACAACAG |
| 2797 | 2798 | 1900-1918 | UGUUGUCCACUGCCCCAGC | GCUGGGGCAGUGGACAACA |
| 2799 | 2800 | 1901-1919 | GUUGUCCACUGCCCCAGCC | GGCUGGGGCAGUGGACAAC |
| 2801 | 2802 | 1902-1920 | UUGUCCACUGCCCCAGCCA | UGGCUGGGGCAGUGGACAA |
| 2803 | 2804 | 1903-1921 | UGUCCACUGCCCCAGCCAC | GUGGCUGGGGCAGUGGACA |
| 2805 | 2806 | 1904-1922 | GUCCACUGCCCCAGCCACA | UGUGGCUGGGGCAGUGGAC |
| 2807 | 2808 | 1905-1923 | UCCACUGCCCCAGCCACAU | AUGUGGCUGGGGCAGUGGA |
| 2809 | 2810 | 1906-1924 | CCACUGCCCCAGCCACAUC | GAUGUGGCUGGGGCAGUGG |
| 2811 | 2812 | 1907-1925 | CACUGCCCCAGCCACAUCA | UGAUGUGGCUGGGGCAGUG |
| 2813 | 2814 | 1908-1926 | ACUGCCCCAGCCACAUCAU | AUGAUGUGGCUGGGGCAGU |
| 2815 | 2816 | 1909-1927 | CUGCCCCAGCCACAUCAUC | GAUGAUGUGGCUGGGGCAG |
| 2817 | 2818 | 1910-1928 | UGCCCCAGCCACAUCAUCC | GGAUGAUGUGGCUGGGGCA |
| 2819 | 2820 | 1911-1929 | GCCCCAGCCACAUCAUCCC | GGGAUGAUGUGGCUGGGGC |
| 2821 | 2822 | 1912-1930 | CCCCAGCCACAUCAUCCCU | AGGGAUGAUGUGGCUGGGG |
| 2823 | 2824 | 1913-1931 | CCCAGCCACAUCAUCCCUG | CAGGGAUGAUGUGGCUGGG |
| 2825 | 2826 | 1914-1932 | CCAGCCACAUCAUCCCUGU | ACAGGGAUGAUGUGGCUGG |
| 2827 | 2828 | 1915-1933 | CAGCCACAUCAUCCCUGUG | CACAGGGAUGAUGUGGCUG |
| 2829 | 2830 | 1916-1934 | AGCCACAUCAUCCCUGUGC | GCACAGGGAUGAUGUGGCU |
| 2831 | 2832 | 1917-1935 | GCCACAUCAUCCCUGUGCG | CGCACAGGGAUGAUGUGGC |
| 2833 | 2834 | 1918-1936 | CCACAUCAUCCCUGUGCGG | CCGCACAGGGAUGAUGUGG |
| 2835 | 2836 | 1919-1937 | CACAUCAUCCCUGUGCGGG | CCCGCACAGGGAUGAUGUG |
| 2837 | 2838 | 1920-1938 | ACAUCAUCCCUGUGCGGGU | ACCCGCACAGGGAUGAUGU |
| 2839 | 2840 | 1922-1940 | AUCAUCCCUGUGCGGGUUG | CAACCCGCACAGGGAUGAU |
| 2841 | 2842 | 1923-1941 | UCAUCCCUGUGCGGGUUGC | GCAACCCGCACAGGGAUGA |
| 2843 | 2844 | 1924-1942 | CAUCCCUGUGCGGGUUGCA | UGCAACCCGCACAGGGAUG |
| 2845 | 2846 | 1925-1943 | AUCCCUGUGCGGGUUGCAG | CUGCAACCCGCACAGGGAU |

TABLE 9-continued

Human ALAS1 siRNA Sense and Antisense Sequences

| SEQ ID NO: (sense) | SEQ ID NO: (anti-sense) | Position on transcript NM_000688.4 | Sense Sequence (5'-3') | Antisense Sequence (5'-3') |
|---|---|---|---|---|
| 2847 | 2848 | 1926-1944 | UCCCUGUGCGGGUUGCAGA | UCUGCAACCCGCACAGGGA |
| 2849 | 2850 | 1928-1946 | CCUGUGCGGGUUGCAGAUG | CAUCUGCAACCCGCACAGG |
| 2851 | 2852 | 1929-1947 | CUGUGCGGGUUGCAGAUGC | GCAUCUGCAACCCGCACAG |
| 2853 | 2854 | 1930-1948 | UGUGCGGGUUGCAGAUGCU | AGCAUCUGCAACCCGCACA |
| 2855 | 2856 | 1931-1949 | GUGCGGGUUGCAGAUGCUG | CAGCAUCUGCAACCCGCAC |
| 2857 | 2858 | 1932-1950 | UGCGGGUUGCAGAUGCUGC | GCAGCAUCUGCAACCCGCA |
| 2859 | 2860 | 1933-1951 | GCGGGUUGCAGAUGCUGCU | AGCAGCAUCUGCAACCCGC |
| 2861 | 2862 | 1934-1952 | CGGGUUGCAGAUGCUGCUA | UAGCAGCAUCUGCAACCCG |
| 2863 | 2864 | 1935-1953 | GGGUUGCAGAUGCUGCUAA | UUAGCAGCAUCUGCAACCC |
| 2865 | 2866 | 1936-1954 | GGUUGCAGAUGCUGCUAAA | UUUAGCAGCAUCUGCAACC |
| 2867 | 2868 | 1937-1955 | GUUGCAGAUGCUGCUAAAA | UUUUAGCAGCAUCUGCAAC |
| 2869 | 2870 | 1938-1956 | UUGCAGAUGCUGCUAAAAA | UUUUUAGCAGCAUCUGCAA |
| 2871 | 2872 | 1939-1957 | UGCAGAUGCUGCUAAAAAC | GUUUUUAGCAGCAUCUGCA |
| 2873 | 2874 | 1940-1958 | GCAGAUGCUGCUAAAAACA | UGUUUUUAGCAGCAUCUGC |
| 2875 | 2876 | 1941-1959 | CAGAUGCUGCUAAAAACAC | GUGUUUUUAGCAGCAUCUG |
| 2877 | 2878 | 1961-1979 | GAAGUCUGUGAUGAACUAA | UUAGUUCAUCACAGACUUC |
| 2879 | 2880 | 1963-1981 | AGUCUGUGAUGAACUAAUG | CAUUAGUUCAUCACAGACU |
| 2881 | 2882 | 1965-1983 | UCUGUGAUGAACUAAUGAG | CUCAUUAGUUCAUCACAGA |
| 2883 | 2884 | 1966-1984 | CUGUGAUGAACUAAUGAGC | GCUCAUUAGUUCAUCACAG |
| 2885 | 2886 | 1968-1986 | GUGAUGAACUAAUGAGCAG | CUGCUCAUUAGUUCAUCAC |
| 2887 | 2888 | 1969-1987 | UGAUGAACUAAUGAGCAGA | UCUGCUCAUUAGUUCAUCA |
| 2889 | 2890 | 1970-1988 | GAUGAACUAAUGAGCAGAC | GUCUGCUCAUUAGUUCAUC |
| 2891 | 2892 | 1971-1989 | AUGAACUAAUGAGCAGACA | UGUCUGCUCAUUAGUUCAU |
| 2893 | 2894 | 1972-1990 | UGAACUAAUGAGCAGACAU | AUGUCUGCUCAUUAGUUCA |
| 2895 | 2896 | 1973-1991 | GAACUAAUGAGCAGACAUA | UAUGUCUGCUCAUUAGUUC |
| 2897 | 2898 | 1974-1992 | AACUAAUGAGCAGACAUAA | UUAUGUCUGCUCAUUAGUU |
| 2899 | 2900 | 1975-1993 | ACUAAUGAGCAGACAUAAC | GUUAUGUCUGCUCAUUAGU |
| 2901 | 2902 | 1978-1996 | AAUGAGCAGACAUAACAUC | GAUGUUAUGUCUGCUCAUU |
| 2903 | 2904 | 1979-1997 | AUGAGCAGACAUAACAUCU | AGAUGUUAUGUCUGCUCAU |
| 2905 | 2906 | 1980-1998 | UGAGCAGACAUAACAUCUA | UAGAUGUUAUGUCUGCUCA |
| 2907 | 2908 | 2000-2018 | GUGCAAGCAAUCAAUUACC | GGUAAUUGAUUGCUUGCAC |
| 2909 | 2910 | 2001-2019 | UGCAAGCAAUCAAUUACCC | GGGUAAUUGAUUGCUUGCA |
| 2911 | 2912 | 2002-2020 | GCAAGCAAUCAAUUACCCU | AGGGUAAUUGAUUGCUUGC |
| 2913 | 2914 | 2004-2022 | AAGCAAUCAAUUACCCUAC | GUAGGGUAAUUGAUUGCUU |
| 2915 | 2916 | 2024-2042 | GUGCCCCGGGGAGAAGAGC | GCUCUUCUCCCCGGGGCAC |
| 2917 | 2918 | 2025-2043 | UGCCCCGGGGAGAAGAGCU | AGCUCUUCUCCCCGGGGCA |

TABLE 9-continued

Human ALAS1 siRNA Sense and Antisense Sequences

| SEQ ID NO: (sense) | SEQ ID NO: (anti-sense) | Position on transcript NM_000688.4 | Sense Sequence (5'-3') | Antisense Sequence (5'-3') |
|---|---|---|---|---|
| 2919 | 2920 | 2026-2044 | GCCCCGGGGAGAAGAGCUC | GAGCUCUUCUCCCCGGGGC |
| 2921 | 2922 | 2027-2045 | CCCCGGGGAGAAGAGCUCC | GGAGCUCUUCUCCCCGGGG |
| 2923 | 2924 | 2028-2046 | CCCGGGGAGAAGAGCUCCU | AGGAGCUCUUCUCCCCGGG |
| 2925 | 2926 | 2029-2047 | CCGGGGAGAAGAGCUCCUA | UAGGAGCUCUUCUCCCCGG |
| 2927 | 2928 | 2030-2048 | CGGGGAGAAGAGCUCCUAC | GUAGGAGCUCUUCUCCCCG |
| 2929 | 2930 | 2031-2049 | GGGGAGAAGAGCUCCUACG | CGUAGGAGCUCUUCUCCCC |
| 2931 | 2932 | 2032-2050 | GGGAGAAGAGCUCCUACGG | CCGUAGGAGCUCUUCUCCC |
| 2933 | 2934 | 2033-2051 | GGAGAAGAGCUCCUACGGA | UCCGUAGGAGCUCUUCUCC |
| 2935 | 2936 | 2034-2052 | GAGAAGAGCUCCUACGGAU | AUCCGUAGGAGCUCUUCUC |
| 2937 | 2938 | 2060-2078 | ACCCCUCACCACACACCCC | GGGGUGUGUGGUGAGGGGU |
| 2939 | 2940 | 2061-2079 | CCCCUCACCACACACCCCA | UGGGGUGUGUGGUGAGGGG |
| 2941 | 2942 | 2062-2080 | CCCUCACCACACACCCCAG | CUGGGGUGUGUGGUGAGGG |
| 2943 | 2944 | 2063-2081 | CCUCACCACACACCCCAGA | UCUGGGGUGUGUGGUGAGG |
| 2945 | 2946 | 2064-2082 | CUCACCACACACCCCAGAU | AUCUGGGGUGUGUGGUGAG |
| 2947 | 2948 | 2065-2083 | UCACCACACACCCCAGAUG | CAUCUGGGGUGUGUGGUGA |
| 2949 | 2950 | 2066-2084 | CACCACACACCCCAGAUGA | UCAUCUGGGGUGUGUGGUG |
| 2951 | 2952 | 2067-2085 | ACCACACACCCCAGAUGAU | AUCAUCUGGGGUGUGUGGU |
| 2953 | 2954 | 2068-2086 | CCACACACCCCAGAUGAUG | CAUCAUCUGGGGUGUGUGG |
| 2955 | 2956 | 2069-2087 | CACACACCCCAGAUGAUGA | UCAUCAUCUGGGGUGUGUG |
| 2957 | 2958 | 2070-2088 | ACACACCCCAGAUGAUGAA | UUCAUCAUCUGGGGUGUGU |
| 2959 | 2960 | 2071-2089 | CACACCCCAGAUGAUGAAC | GUUCAUCAUCUGGGGUGUG |
| 2961 | 2962 | 2072-2090 | ACACCCCAGAUGAUGAACU | AGUUCAUCAUCUGGGGUGU |
| 2963 | 2964 | 2073-2091 | CACCCCAGAUGAUGAACUA | UAGUUCAUCAUCUGGGGUG |
| 2965 | 2966 | 2074-2092 | ACCCCAGAUGAUGAACUAC | GUAGUUCAUCAUCUGGGGU |
| 2967 | 2968 | 2076-2094 | CCCAGAUGAUGAACUACUU | AAGUAGUUCAUCAUCUGGG |
| 2969 | 2970 | 2077-2095 | CCAGAUGAUGAACUACUUC | GAAGUAGUUCAUCAUCUGG |
| 2971 | 2972 | 2078-2096 | CAGAUGAUGAACUACUUCC | GGAAGUAGUUCAUCAUCUG |
| 2973 | 2974 | 2079-2097 | AGAUGAUGAACUACUUCCU | AGGAAGUAGUUCAUCAUCU |
| 2975 | 2976 | 2080-2098 | GAUGAUGAACUACUUCCUU | AAGGAAGUAGUUCAUCAUC |
| 2977 | 2978 | 2081-2099 | AUGAUGAACUACUUCCUUG | CAAGGAAGUAGUUCAUCAU |
| 2979 | 2980 | 2082-2100 | UGAUGAACUACUUCCUUGA | UCAAGGAAGUAGUUCAUCA |
| 2981 | 2982 | 2083-2101 | GAUGAACUACUUCCUUGAG | CUCAAGGAAGUAGUUCAUC |
| 2983 | 2984 | 2084-2102 | AUGAACUACUUCCUUGAGA | UCUCAAGGAAGUAGUUCAU |
| 2985 | 2986 | 2085-2103 | UGAACUACUUCCUUGAGAA | UUCUCAAGGAAGUAGUUCA |
| 2987 | 2988 | 2086-2104 | GAACUACUUCCUUGAGAAU | AUUCUCAAGGAAGUAGUUC |
| 2989 | 2990 | 2087-2105 | AACUACUUCCUUGAGAAUC | GAUUCUCAAGGAAGUAGUU |

TABLE 9-continued

Human ALAS1 siRNA Sense and Antisense Sequences

| SEQ ID NO: (sense) | SEQ ID NO: (antisense) | Position on transcript NM_000688.4 | Sense Sequence (5'-3') | Antisense Sequence (5'-3') |
|---|---|---|---|---|
| 2991 | 2992 | 2088-2106 | ACUACUUCCUUGAGAAUCU | AGAUUCUCAAGGAAGUAGU |
| 2993 | 2994 | 2089-2107 | CUACUUCCUUGAGAAUCUG | CAGAUUCUCAAGGAAGUAG |
| 2995 | 2996 | 2090-2108 | UACUUCCUUGAGAAUCUGC | GCAGAUUCUCAAGGAAGUA |
| 2997 | 2998 | 2091-2109 | ACUUCCUUGAGAAUCUGCU | AGCAGAUUCUCAAGGAAGU |
| 2999 | 3000 | 2117-2135 | UGGAAGCAAGUGGGGCUGG | CCAGCCCCACUUGCUUCCA |
| 3001 | 3002 | 2118-2136 | GGAAGCAAGUGGGGCUGGA | UCCAGCCCCACUUGCUUCC |
| 3003 | 3004 | 2119-2137 | GAAGCAAGUGGGGCUGGAA | UUCCAGCCCCACUUGCUUC |
| 3005 | 3006 | 2120-2138 | AAGCAAGUGGGGCUGGAAC | GUUCCAGCCCCACUUGCUU |
| 3007 | 3008 | 2121-2139 | AGCAAGUGGGGCUGGAACU | AGUUCCAGCCCCACUUGCU |
| 3009 | 3010 | 2122-2140 | GCAAGUGGGGCUGGAACUG | CAGUUCCAGCCCCACUUGC |
| 3011 | 3012 | 2123-2141 | CAAGUGGGGCUGGAACUGA | UCAGUUCCAGCCCCACUUG |
| 3013 | 3014 | 2124-2142 | AAGUGGGGCUGGAACUGAA | UUCAGUUCCAGCCCCACUU |
| 3015 | 3016 | 2125-2143 | AGUGGGGCUGGAACUGAAG | CUUCAGUUCCAGCCCCACU |
| 3017 | 3018 | 2126-2144 | GUGGGGCUGGAACUGAAGC | GCUUCAGUUCCAGCCCCAC |
| 3019 | 3020 | 2127-2145 | UGGGGCUGGAACUGAAGCC | GGCUUCAGUUCCAGCCCCA |
| 3021 | 3022 | 2147-2165 | CAUUCCUCAGCUGAGUGCA | UGCACUCAGCUGAGGAAUG |
| 3023 | 3024 | 2148-2166 | AUUCCUCAGCUGAGUGCAA | UUGCACUCAGCUGAGGAAU |
| 3025 | 3026 | 2149-2167 | UUCCUCAGCUGAGUGCAAC | GUUGCACUCAGCUGAGGAA |
| 3027 | 3028 | 2150-2168 | UCCUCAGCUGAGUGCAACU | AGUUGCACUCAGCUGAGGA |
| 3029 | 3030 | 2151-2169 | CCUCAGCUGAGUGCAACUU | AAGUUGCACUCAGCUGAGG |
| 3031 | 3032 | 2152-2170 | CUCAGCUGAGUGCAACUUC | GAAGUUGCACUCAGCUGAG |
| 3033 | 3034 | 2153-2171 | UCAGCUGAGUGCAACUUCU | AGAAGUUGCACUCAGCUGA |
| 3035 | 3036 | 2154-2172 | CAGCUGAGUGCAACUUCUG | CAGAAGUUGCACUCAGCUG |
| 3037 | 3038 | 2155-2173 | AGCUGAGUGCAACUUCUGC | GCAGAAGUUGCACUCAGCU |
| 3039 | 3040 | 2156-2174 | GCUGAGUGCAACUUCUGCA | UGCAGAAGUUGCACUCAGC |
| 3041 | 3042 | 2157-2175 | CUGAGUGCAACUUCUGCAG | CUGCAGAAGUUGCACUCAG |
| 3043 | 3044 | 2158-2176 | UGAGUGCAACUUCUGCAGG | CCUGCAGAAGUUGCACUCA |
| 3045 | 3046 | 2159-2177 | GAGUGCAACUUCUGCAGGA | UCCUGCAGAAGUUGCACUC |
| 3047 | 3048 | 2160-2178 | AGUGCAACUUCUGCAGGAG | CUCCUGCAGAAGUUGCACU |
| 3049 | 3050 | 2161-2179 | GUGCAACUUCUGCAGGAGG | CCUCCUGCAGAAGUUGCAC |
| 3051 | 3052 | 2162-2180 | UGCAACUUCUGCAGGAGGC | GCCUCCUGCAGAAGUUGCA |
| 3053 | 3054 | 2163-2181 | GCAACUUCUGCAGGAGGCC | GGCCUCCUGCAGAAGUUGC |
| 3055 | 3056 | 2164-2182 | CAACUUCUGCAGGAGGCCA | UGGCCUCCUGCAGAAGUUG |
| 3057 | 3058 | 2165-2183 | AACUUCUGCAGGAGGCCAC | GUGGCCUCCUGCAGAAGUU |
| 3059 | 3060 | 2166-2184 | ACUUCUGCAGGAGGCCACU | AGUGGCCUCCUGCAGAAGU |
| 3061 | 3062 | 2167-2185 | CUUCUGCAGGAGGCCACUG | CAGUGGCCUCCUGCAGAAG |

TABLE 9-continued

Human ALAS1 siRNA Sense and Antisense Sequences

| SEQ ID NO: (sense) | SEQ ID NO: (anti-sense) | Position on transcript NM_000688.4 | Sense Sequence (5'-3') | Antisense Sequence (5'-3') |
|---|---|---|---|---|
| 3063 | 3064 | 2168-2186 | UUCUGCAGGAGGCCACUGC | GCAGUGGCCUCCUGCAGAA |
| 3065 | 3066 | 2169-2187 | UCUGCAGGAGGCCACUGCA | UGCAGUGGCCUCCUGCAGA |
| 3067 | 3068 | 2170-2188 | CUGCAGGAGGCCACUGCAU | AUGCAGUGGCCUCCUGCAG |
| 3069 | 3070 | 2171-2189 | UGCAGGAGGCCACUGCAUU | AAUGCAGUGGCCUCCUGCA |
| 3071 | 3072 | 2172-2190 | GCAGGAGGCCACUGCAUUU | AAAUGCAGUGGCCUCCUGC |
| 3073 | 3074 | 2173-2191 | CAGGAGGCCACUGCAUUUU | AAAAUGCAGUGGCCUCCUG |
| 3075 | 3076 | 2174-2192 | AGGAGGCCACUGCAUUUUG | CAAAAUGCAGUGGCCUCCU |
| 3077 | 3078 | 2175-2193 | GGAGGCCACUGCAUUUUGA | UCAAAAUGCAGUGGCCUCC |
| 3079 | 3080 | 2176-2194 | GAGGCCACUGCAUUUUGAA | UUCAAAAUGCAGUGGCCUC |
| 3081 | 3082 | 2177-2195 | AGGCCACUGCAUUUUGAAG | CUUCAAAAUGCAGUGGCCU |
| 3083 | 3084 | 2178-2196 | GGCCACUGCAUUUUGAAGU | ACUUCAAAAUGCAGUGGCC |
| 3085 | 3086 | 2179-2197 | GCCACUGCAUUUUGAAGUG | CACUUCAAAAUGCAGUGGC |
| 3087 | 3088 | 2180-2198 | CCACUGCAUUUUGAAGUGA | UCACUUCAAAAUGCAGUGG |
| 3089 | 3090 | 2181-2199 | CACUGCAUUUUGAAGUGAU | AUCACUUCAAAAUGCAGUG |
| 3091 | 3092 | 2182-2200 | ACUGCAUUUUGAAGUGAUG | CAUCACUUCAAAAUGCAGU |
| 3093 | 3094 | 2183-2201 | CUGCAUUUUGAAGUGAUGA | UCAUCACUUCAAAAUGCAG |
| 3095 | 3096 | 2184-2202 | UGCAUUUUGAAGUGAUGAG | CUCAUCACUUCAAAAUGCA |
| 3097 | 3098 | 2185-2203 | GCAUUUUGAAGUGAUGAGU | ACUCAUCACUUCAAAAUGC |
| 3099 | 3100 | 2186-2204 | CAUUUUGAAGUGAUGAGUG | CACUCAUCACUUCAAAAUG |
| 3101 | 3102 | 2187-2205 | AUUUUGAAGUGAUGAGUGA | UCACUCAUCACUUCAAAAU |
| 3103 | 3104 | 2188-2206 | UUUUGAAGUGAUGAGUGAA | UUCACUCAUCACUUCAAAA |
| 3105 | 3106 | 2190-2208 | UUGAAGUGAUGAGUGAAAG | CUUUCACUCAUCACUUCAA |
| 3107 | 3108 | 2191-2209 | UGAAGUGAUGAGUGAAAGA | UCUUUCACUCAUCACUUCA |
| 3109 | 3110 | 2192-2210 | GAAGUGAUGAGUGAAAGAG | CUCUUUCACUCAUCACUUC |
| 3111 | 3112 | 2193-2211 | AAGUGAUGAGUGAAAGAGA | UCUCUUUCACUCAUCACUU |
| 3113 | 3114 | 2194-2212 | AGUGAUGAGUGAAAGAGAG | CUCUCUUUCACUCAUCACU |
| 3115 | 3116 | 2195-2213 | GUGAUGAGUGAAAGAGAGA | UCUCUCUUUCACUCAUCAC |
| 3117 | 3118 | 2196-2214 | UGAUGAGUGAAAGAGAGAA | UUCUCUCUUUCACUCAUCA |
| 3119 | 3120 | 2197-2215 | GAUGAGUGAAAGAGAGAAG | CUUCUCUCUUUCACUCAUC |
| 3121 | 3122 | 2198-2216 | AUGAGUGAAAGAGAGAAGU | ACUUCUCUCUUUCACUCAU |
| 3123 | 3124 | 2199-2217 | UGAGUGAAAGAGAGAAGUC | GACUUCUCUCUUUCACUCA |
| 3125 | 3126 | 2200-2218 | GAGUGAAAGAGAGAAGUCC | GGACUUCUCUCUUUCACUC |
| 3127 | 3128 | 2201-2219 | AGUGAAAGAGAGAAGUCCU | AGGACUUCUCUCUUUCACU |
| 3129 | 3130 | 2202-2220 | GUGAAAGAGAGAAGUCCUA | UAGGACUUCUCUCUUUCAC |
| 3131 | 3132 | 2203-2221 | UGAAAGAGAGAAGUCCUAU | AUAGGACUUCUCUCUUUCA |
| 3133 | 3134 | 2204-2222 | GAAAGAGAGAAGUCCUAUU | AAUAGGACUUCUCUCUUUC |

TABLE 9-continued

Human ALAS1 siRNA Sense and Antisense Sequences

| SEQ ID NO: (sense) | SEQ ID NO: (antisense) | Position on transcript NM_000688.4 | Sense Sequence (5'-3') | Antisense Sequence (5'-3') |
|---|---|---|---|---|
| 3135 | 3136 | 2205-2223 | AAAGAGAGAAGUCCUAUUU | AAAUAGGACUUCUCUCUUU |
| 3137 | 3138 | 2206-2224 | AAGAGAGAAGUCCUAUUUC | GAAAUAGGACUUCUCUCUU |
| 3139 | 3140 | 2207-2225 | AGAGAGAAGUCCUAUUUCU | AGAAAUAGGACUUCUCUCU |
| 3141 | 3142 | 2208-2226 | GAGAGAAGUCCUAUUUCUC | GAGAAAUAGGACUUCUCUC |
| 3143 | 3144 | 2209-2227 | AGAGAAGUCCUAUUUCUCA | UGAGAAAUAGGACUUCUCU |
| 3145 | 3146 | 2210-2228 | GAGAAGUCCUAUUUCUCAG | CUGAGAAAUAGGACUUCUC |
| 3147 | 3148 | 2211-2229 | AGAAGUCCUAUUUCUCAGG | CCUGAGAAAUAGGACUUCU |
| 3149 | 3150 | 2212-2230 | GAAGUCCUAUUUCUCAGGC | GCCUGAGAAAUAGGACUUC |
| 3151 | 3152 | 2213-2231 | AAGUCCUAUUUCUCAGGCU | AGCCUGAGAAAUAGGACUU |
| 3153 | 3154 | 2214-2232 | AGUCCUAUUUCUCAGGCUU | AAGCCUGAGAAAUAGGACU |
| 3155 | 3156 | 2215-2233 | GUCCUAUUUCUCAGGCUUG | CAAGCCUGAGAAAUAGGAC |
| 3157 | 3158 | 2216-2234 | UCCUAUUUCUCAGGCUUGA | UCAAGCCUGAGAAAUAGGA |
| 3159 | 3160 | 2217-2235 | CCUAUUUCUCAGGCUUGAG | CUCAAGCCUGAGAAAUAGG |
| 3161 | 3162 | 2218-2236 | CUAUUUCUCAGGCUUGAGC | GCUCAAGCCUGAGAAAUAG |
| 3163 | 3164 | 2219-2237 | UAUUUCUCAGGCUUGAGCA | UGCUCAAGCCUGAGAAAUA |
| 3165 | 3166 | 2220-2238 | AUUUCUCAGGCUUGAGCAA | UUGCUCAAGCCUGAGAAAU |
| 3167 | 3168 | 2221-2239 | UUUCUCAGGCUUGAGCAAG | CUUGCUCAAGCCUGAGAAA |
| 3169 | 3170 | 2222-2240 | UUCUCAGGCUUGAGCAAGU | ACUUGCUCAAGCCUGAGAA |
| 3171 | 3172 | 2223-2241 | UCUCAGGCUUGAGCAAGUU | AACUUGCUCAAGCCUGAGA |
| 3173 | 3174 | 2224-2242 | CUCAGGCUUGAGCAAGUUG | CAACUUGCUCAAGCCUGAG |
| 3175 | 3176 | 2225-2243 | UCAGGCUUGAGCAAGUUGG | CCAACUUGCUCAAGCCUGA |
| 3177 | 3178 | 2226-2244 | CAGGCUUGAGCAAGUUGGU | ACCAACUUGCUCAAGCCUG |
| 3179 | 3180 | 2229-2247 | GCUUGAGCAAGUUGGUAUC | GAUACCAACUUGCUCAAGC |
| 3181 | 3182 | 2231-2249 | UUGAGCAAGUUGGUAUCUG | CAGAUACCAACUUGCUCAA |
| 3183 | 3184 | 2232-2250 | UGAGCAAGUUGGUAUCUGC | GCAGAUACCAACUUGCUCA |
| 3185 | 3186 | 2233-2251 | GAGCAAGUUGGUAUCUGCU | AGCAGAUACCAACUUGCUC |
| 3187 | 3188 | 2234-2252 | AGCAAGUUGGUAUCUGCUC | GAGCAGAUACCAACUUGCU |
| 3189 | 3190 | 2235-2253 | GCAAGUUGGUAUCUGCUCA | UGAGCAGAUACCAACUUGC |
| 3191 | 3192 | 2236-2254 | CAAGUUGGUAUCUGCUCAG | CUGAGCAGAUACCAACUUG |
| 3193 | 3194 | 2237-2255 | AAGUUGGUAUCUGCUCAGG | CCUGAGCAGAUACCAACUU |
| 3195 | 3196 | 2238-2256 | AGUUGGUAUCUGCUCAGGC | GCCUGAGCAGAUACCAACU |
| 3197 | 3198 | 2239-2257 | GUUGGUAUCUGCUCAGGCC | GGCCUGAGCAGAUACCAAC |
| 3199 | 3200 | 2240-2258 | UUGGUAUCUGCUCAGGCCU | AGGCCUGAGCAGAUACCAA |
| 3201 | 3202 | 2241-2259 | UGGUAUCUGCUCAGGCCUG | CAGGCCUGAGCAGAUACCA |
| 3203 | 3204 | 2242-2260 | GGUAUCUGCUCAGGCCUGA | UCAGGCCUGAGCAGAUACC |
| 3205 | 3206 | 2243-2261 | GUAUCUGCUCAGGCCUGAG | CUCAGGCCUGAGCAGAUAC |

TABLE 9-continued

Human ALAS1 siRNA Sense and Antisense Sequences

| SEQ ID NO: (sense) | SEQ ID NO: (antisense) | Position on transcript NM_000688.4 | Sense Sequence (5'-3') | Antisense Sequence (5'-3') |
|---|---|---|---|---|
| 3207 | 3208 | 2244-2262 | UAUCUGCUCAGGCCUGAGC | GCUCAGGCCUGAGCAGAUA |
| 3209 | 3210 | 2245-2263 | AUCUGCUCAGGCCUGAGCA | UGCUCAGGCCUGAGCAGAU |
| 3211 | 3212 | 2246-2264 | UCUGCUCAGGCCUGAGCAU | AUGCUCAGGCCUGAGCAGA |
| 3213 | 3214 | 2247-2265 | CUGCUCAGGCCUGAGCAUG | CAUGCUCAGGCCUGAGCAG |
| 3215 | 3216 | 2248-2266 | UGCUCAGGCCUGAGCAUGA | UCAUGCUCAGGCCUGAGCA |
| 3217 | 3218 | 2249-2267 | GCUCAGGCCUGAGCAUGAC | GUCAUGCUCAGGCCUGAGC |
| 3219 | 3220 | 2250-2268 | CUCAGGCCUGAGCAUGACC | GGUCAUGCUCAGGCCUGAG |
| 3221 | 3222 | 2251-2269 | UCAGGCCUGAGCAUGACCU | AGGUCAUGCUCAGGCCUGA |
| 3223 | 3224 | 2252-2270 | CAGGCCUGAGCAUGACCUC | GAGGUCAUGCUCAGGCCUG |
| 3225 | 3226 | 2253-2271 | AGGCCUGAGCAUGACCUCA | UGAGGUCAUGCUCAGGCCU |
| 3227 | 3228 | 2279-2297 | CACUUAACCCCAGGCCAUU | AAUGGCCUGGGGUUAAGUG |
| 3229 | 3230 | 2280-2298 | ACUUAACCCCAGGCCAUUA | UAAUGGCCUGGGGUUAAGU |
| 3231 | 3232 | 2281-2299 | CUUAACCCCAGGCCAUUAU | AUAAUGGCCUGGGGUUAAG |
| 3233 | 3234 | 2282-2300 | UUAACCCCAGGCCAUUAUC | GAUAAUGGCCUGGGGUUAA |
| 3235 | 3236 | 2283-2301 | UAACCCCAGGCCAUUAUCA | UGAUAAUGGCCUGGGGUUA |
| 3237 | 3238 | 2284-2302 | AACCCCAGGCCAUUAUCAU | AUGAUAAUGGCCUGGGGUU |
| 3239 | 3240 | 2285-2303 | ACCCCAGGCCAUUAUCAUA | UAUGAUAAUGGCCUGGGGU |
| 3241 | 3242 | 2287-2305 | CCCAGGCCAUUAUCAUAUC | GAUAUGAUAAUGGCCUGGG |
| 3243 | 3244 | 2288-2306 | CCAGGCCAUUAUCAUAUCC | GGAUAUGAUAAUGGCCUGG |
| 3245 | 3246 | 2289-2307 | CAGGCCAUUAUCAUAUCCA | UGGAUAUGAUAAUGGCCUG |
| 3247 | 3248 | 2290-2308 | AGGCCAUUAUCAUAUCCAG | CUGGAUAUGAUAAUGGCCU |
| 3249 | 3250 | 2291-2309 | GGCCAUUAUCAUAUCCAGA | UCUGGAUAUGAUAAUGGCC |
| 3251 | 3252 | 2292-2310 | GCCAUUAUCAUAUCCAGAU | AUCUGGAUAUGAUAAUGGC |
| 3253 | 3254 | 2314-2332 | CUUCAGAGUUGUCUUUAUA | UAUAAAGACAACUCUGAAG |
| 3255 | 3256 | 2315-2333 | UUCAGAGUUGUCUUUAUAU | AUAUAAAGACAACUCUGAA |
| 3257 | 3258 | 2316-2334 | UCAGAGUUGUCUUUAUAUG | CAUAUAAAGACAACUCUGA |
| 3259 | 3260 | 2318-2336 | AGAGUUGUCUUUAUAUGUG | CACAUAUAAAGACAACUCU |
| 3261 | 3262 | 2322-2340 | UUGUCUUUAUAUGUGAAUU | AAUUCACAUAUAAAGACAA |
| 3263 | 3264 | 2323-2341 | UGUCUUUAUAUGUGAAUUA | UAAUUCACAUAUAAAGACA |
| 3265 | 3266 | 2324-2342 | GUCUUUAUAUGUGAAUUAA | UUAAUUCACAUAUAAAGAC |
| 3267 | 3268 | 2325-2343 | UCUUUAUAUGUGAAUUAAG | CUUAAUUCACAUAUAAAGA |
| 3269 | 3270 | 2326-2344 | CUUUAUAUGUGAAUUAAGU | ACUUAAUUCACAUAUAAAG |
| 3271 | 3272 | 2327-2345 | UUUAUAUGUGAAUUAAGUU | AACUUAAUUCACAUAUAAA |
| 3273 | 3274 | 2328-2346 | UUAUAUGUGAAUUAAGUUA | UAACUUAAUUCACAUAUAA |
| 3275 | 3276 | 2329-2347 | UAUAUGUGAAUUAAGUUAU | AUAACUUAAUUCACAUAUA |
| 3277 | 3278 | 2330-2348 | AUAUGUGAAUUAAGUUAUA | UAUAACUUAAUUCACAUAU |

TABLE 9-continued

Human ALAS1 siRNA Sense and Antisense Sequences

| SEQ ID NO: (sense) | SEQ ID NO: (antisense) | Position on transcript NM_000688.4 | Sense Sequence (5'-3') | Antisense Sequence (5'-3') |
|---|---|---|---|---|
| 3279 | 3280 | 2331-2349 | UAUGUGAAUUAAGUUAUAU | AUAUAACUUAAUUCACAUA |
| 3281 | 3282 | 2332-2350 | AUGUGAAUUAAGUUAUAUU | AAUAUAACUUAAUUCACAU |
| 3283 | 3284 | 2333-2351 | UGUGAAUUAAGUUAUAUUA | UAAUAUAACUUAAUUCACA |
| 3285 | 3286 | 2334-2352 | GUGAAUUAAGUUAUAUUAA | UUAAUAUAACUUAAUUCAC |
| 3287 | 3288 | 2335-2353 | UGAAUUAAGUUAUAUUAAA | UUUAAUAUAACUUAAUUCA |
| 3289 | 3290 | 2336-2354 | GAAUUAAGUUAUAUUAAAU | AUUUAAUAUAACUUAAUUC |
| 3291 | 3292 | 2337-2355 | AAUUAAGUUAUAUUAAAUU | AAUUUAAUAUAACUUAAUU |
| 3293 | 3294 | 2338-2356 | AUUAAGUUAUAUUAAAUUU | AAAUUUAAUAUAACUUAAU |
| 3295 | 3296 | 2339-2357 | UUAAGUUAUAUUAAAUUUU | AAAAUUUAAUAUAACUUAA |
| 3297 | 3298 | 2340-2358 | UAAGUUAUAUUAAAUUUUA | UAAAAUUUAAUAUAACUUA |
| 3299 | 3300 | 2341-2359 | AAGUUAUAUUAAAUUUUAA | UUAAAAUUUAAUAUAACUU |
| 3301 | 3302 | 2342-2360 | AGUUAUAUUAAAUUUUAAU | AUUAAAAUUUAAUAUAACU |
| 3303 | 3304 | 2343-2361 | GUUAUAUUAAAUUUUAAUC | GAUUAAAAUUUAAUAUAAC |
| 3305 | 3306 | 2345-2363 | UAUAUUAAAUUUUAAUCUA | UAGAUUAAAAUUUAAUAUA |
| 3307 | 3308 | 2346-2364 | AUAUUAAAUUUUAAUCUAU | AUAGAUUAAAAUUUAAUAU |
| 3309 | 3310 | 2347-2365 | UAUUAAAUUUUAAUCUAUA | UAUAGAUUAAAAUUUAAUA |
| 3311 | 3312 | 2348-2366 | AUUAAAUUUUAAUCUAUAG | CUAUAGAUUAAAAUUUAAU |
| 3313 | 3314 | 2349-2367 | UUAAAUUUUAAUCUAUAGU | ACUAUAGAUUAAAAUUUAA |
| 3315 | 3316 | 2350-2368 | UAAAUUUUAAUCUAUAGUA | UACUAUAGAUUAAAAUUUA |
| 3317 | 3318 | 2351-2369 | AAAUUUUAAUCUAUAGUAA | UUACUAUAGAUUAAAAUUU |
| 3319 | 3320 | 2354-2372 | UUUUAAUCUAUAGUAAAAA | UUUUUACUAUAGAUUAAAA |
| 3321 | 3322 | 2355-2373 | UUUAAUCUAUAGUAAAAAC | GUUUUUACUAUAGAUUAAA |
| 3323 | 3324 | 2356-2374 | UUAAUCUAUAGUAAAAACA | UGUUUUUACUAUAGAUUAA |
| 3325 | 3326 | 2357-2375 | UAAUCUAUAGUAAAAACAU | AUGUUUUUACUAUAGAUUA |
| 3327 | 3328 | 2358-2376 | AAUCUAUAGUAAAAACAUA | UAUGUUUUUACUAUAGAUU |
| 3329 | 3330 | 2359-2377 | AUCUAUAGUAAAAACAUAG | CUAUGUUUUUACUAUAGAU |
| 3331 | 3332 | 2360-2378 | UCUAUAGUAAAAACAUAGU | ACUAUGUUUUUACUAUAGA |
| 3333 | 3334 | 2361-2379 | CUAUAGUAAAAACAUAGUC | GACUAUGUUUUUACUAUAG |
| 3335 | 3336 | 2362-2380 | UAUAGUAAAAACAUAGUCC | GGACUAUGUUUUUACUAUA |
| 3337 | 3338 | 2363-2381 | AUAGUAAAAACAUAGUCCU | AGGACUAUGUUUUUACUAU |
| 3339 | 3340 | 2364-2382 | UAGUAAAAACAUAGUCCUG | CAGGACUAUGUUUUUACUA |
| 3341 | 3342 | 2365-2383 | AGUAAAAACAUAGUCCUGG | CCAGGACUAUGUUUUUACU |
| 3343 | 3344 | 2366-2384 | GUAAAAACAUAGUCCUGGA | UCCAGGACUAUGUUUUUAC |
| 3345 | 3346 | 2367-2385 | UAAAAACAUAGUCCUGGAA | UUCCAGGACUAUGUUUUUA |
| 3347 | 3348 | 2368-2386 | AAAAACAUAGUCCUGGAAA | UUUCCAGGACUAUGUUUUU |
| 3349 | 3350 | 2369-2387 | AAAACAUAGUCCUGGAAAU | AUUUCCAGGACUAUGUUUU |

TABLE 9-continued

Human ALAS1 siRNA Sense and Antisense Sequences

| SEQ ID NO: (sense) | SEQ ID NO: (anti-sense) | Position on transcript NM_000688.4 | Sense Sequence (5'-3') | Antisense Sequence (5'-3') |
|---|---|---|---|---|
| 3351 | 3352 | 2370-2388 | AAACAUAGUCCUGGAAAUA | UAUUUCCAGGACUAUGUUU |
| 3353 | 3354 | 2371-2389 | AACAUAGUCCUGGAAAUAA | UUAUUUCCAGGACUAUGUU |
| 3355 | 3356 | 2372-2390 | ACAUAGUCCUGGAAAUAAA | UUUAUUUCCAGGACUAUGU |
| 3357 | 3358 | 2373-2391 | CAUAGUCCUGGAAAUAAAU | AUUUAUUUCCAGGACUAUG |
| 3359 | 3360 | 2374-2392 | AUAGUCCUGGAAAUAAAUU | AAUUUAUUUCCAGGACUAU |
| 3361 | 3362 | 2375-2393 | UAGUCCUGGAAAUAAAUUC | GAAUUUAUUUCCAGGACUA |
| 3363 | 3364 | 2377-2395 | GUCCUGGAAAUAAAUUCUU | AAGAAUUUAUUUCCAGGAC |
| 3365 | 3366 | 2378-2396 | UCCUGGAAAUAAAUUCUUG | CAAGAAUUUAUUUCCAGGA |

Example 9

Suppression of Porphyrin Precursors Using ALAS1 siRNA in an Acute Treatment Paradigm The AIP mouse model (see Example 5) was used to investigate whether ALAS1 siRNA would work an an acute treatment paradigm to lower already elevated levels of ALA and PBG, as would be present, for example, when a human porphyria patient suffers from an acute attack. Administration of the AD-53558 LNP11 formulation siRNA at a 1 mg/kg dose 12 hours after the last dose of phenobarbital rapidly decreased the levels of both ALA and PBG in mouse plasma, whereas in Luc control treated animals the levels continued to rise (FIG. 14). These results indicate that ALAS siRNA is effective for treating an acute attack. The ALAS1 siRNA was effective to lower and prevent further increases in ALA and PBG levels.

Example 10 siRNAs that Target ALAS1

Further unmodified and modified siRNA sequences that target ALAS1 siRNA were designed and produced as described in Example 2. The in vitro activity of the modified duplexes was tested as described below.
Methods
Lipid Mediated Transfection For Hep3B, PMH, and primary Cynomolgus hepatocytes, transfection was carried out by adding 14.8 µl of Opti-MEM plus 0.2 µl of Lipofectamine RNAiMax per well (Invitrogen, Carlsbad Calif. catalog number 13778-150) to 5 µl of each siRNA duplex to an individual well in a 96-well plate. The mixture was then incubated at room temperature for 20 minutes. Eighty µl of complete growth media without antibiotic containing the appropriate cell number were then added to the siRNA mixture. Cells were incubated for 24 hours prior to RNA purification.

Single dose experiments were performed at 1 uM, 500 nM, 20 nM, 10 nM and 0.2 nM final duplex concentration for GalNAc modified.

Free Uptake Transfection

Cryopreserved Primary Cynomolgus Hepatocytes (Celsis In Vitro Technologies, M003055-P) were thawed at 37° C. water bath immediately prior to usage and re-suspended at $0.26 \times 10^6$ cells/ml in InVitroGRO CP (plating) medium (Celsis In Vitro Technologies, catalog number Z99029). During transfections, cells were plated onto a BD BioCoat 96 well collagen plate (BD, 356407) at 25,000 cells per well and incubated at 37° C. in an atmosphere of 5% $CO_2$. Free Uptake experiments were performed by adding 10 µl of siRNA duplexes in PBS per well into a 96 well (96w) plate. Ninety µl of complete growth media containing appropriate cell number for the cell type was then added to the siRNA. Cells were incubated for 24 hours prior to RNA purification. Single dose experiments were performed at 1 uM, 500 nM, 20 nM and 10 nM final duplex.

Total RNA Isolation Using DYNABEADS mRNA Isolation Kit (Invitrogen, Part #: 610-12)

Cells were harvested and lysed in 150 µl of Lysis/Binding Buffer then mixed for 5 minutes at 850 rpm using an Eppendorf Thermomixer (the mixing speed was the same throughout the process). Ten microliters of magnetic beads and 80 µl Lysis/Binding Buffer mixture were added to a round bottom plate and mixed for 1 minute. Magnetic beads were captured using a magnetic stand and the supernatant was removed without disturbing the beads. After removing the supernatant, the lysed cells were added to the remaining beads and mixed for 5 minutes. After removing the supernatant, magnetic beads were washed 2 times with 150 µl Wash Buffer A and mixed for 1 minute. The beads were capturedagain and the supernatant was removed. The beads were then washed with 150 µl Wash Buffer B, captured and the supernatant was removed. The beads were next washed with 150 µl Elution Buffer, captured and the supernatant removed. Finally, the beads were allowed to dry for 2 minutes. After drying, 50 µl of Elution Buffer was added and mixed for 5 minutes at 70° C. The beads were captured on magnet for 5 minutes. Forty-five µl of supernatant was removed and added to another 96 well plate.

cDNA Synthesis Using ABI High Capacity cDNA Reverse Transcription Kit (Applied Biosystems, Foster City, Calif., Cat #4368813)

A master mix of 2 µl 10× Buffer, 0.8 µl 25× dNTPs, 2 µl Random primers, 1 µl Reverse Transcriptase, 1 µl RNase inhibitor and 3.2 μl of H2O per reaction as prepared. Equal volumes master mix and RNA were mixed for a final volume of 12 μl for in vitro screened or 20 μl for in vivo screened samples. cDNA was generated using a Bio-Rad C-1000 or S-1000 thermal cycler (Hercules, Calif.) through the following steps: 25° C. for 10 minutes, 37° C. for 120 minutes, 85° C. for 5 seconds, and 4° C. hold.

Real Time PCR

Two μl of cDNA were added to a master mix containing 2 μl of H₂O, 0.5 μl GAPDH TaqMan Probe (Life Technologies catalog number 4326317E for Hep3B cells, catalog number 352339E for primary mouse hepatocytes or custom probe for cynomolgus primary hepatocytes), 0.5 μl C5 TaqMan probe (Life Technologies catalog number Hs00167441_m1 for Hep3B cells or Mm00457879_m1 for Primary Mouse Hepatoctyes or custom probe for cynomolgus primary hepatocytes) and 50 Lightcycler 480 probe master mix (Roche catalog number 04887301001) per well in a 384 well (384 w) plates (Roche catalog number 04887301001). Real time PCR was performed in an Roche LC480 Real Time PCR system (Roche) using the ΔΔCt(RQ) assay. For in vitro screening, each duplex was tested with two biological replicates unless otherwise noted and each Real Time PCR was performed in duplicate technical replicates. For in vivo screening, each duplex was tested in one or more experiments (3 mice per group) and each Real Time PCR was run in duplicate technical replicates.

To calculate relative fold change in ALAS1 mRNA levels, real time data were analyzed using the ΔΔCt method and normalized to assays performed with cells transfected with 10 nM AD-1955, or mock transfected cells. $IC_{50}$s were calculated using a 4 parameter fit model using XLFit and normalized to cells transfected with AD-1955 over the same dose range, or to its own lowest dose.

The sense and antisense sequences of AD-1955 are:

```
                                        (SEQ ID NO: 3682)
    SENSE:      cuuAcGcuGAGuAcuucGAdTsdT (SEQ ID NO: 3683)
    ANTISENSE:  UCGAAGuACUcAGCGuAAGdTsdT.
```

The single strand and duplex sequences of the modified and unmodified siRNAs are provided in Table 14 and Table 15, respectively.

TABLE 14

Human ALAS1 Modified Single Strands and Duplex Sequences

| SEQ ID NO: (sense) | SEQ ID NO: (antisense) | Duplex Name | Sense Sequence (5'-3') | Antisense Sequence (5'-3') | Target sites of antisense sequence on NM_000688.4 |
|---|---|---|---|---|---|
| 3371 | 3372 | AD-58848 | CfsasUfgCfcAfaAfAfAfuGfgAfcAfuCfaUfL96 | asUfsgAfuGfuCfcAfuuuUfuGfgCfaUfgsAfsc | 1635-1657 |
| 3373 | 3374 | AD-58849 | AfsusUfuUfgAfaGfUfGfaUfgAfgUfgAfaAfL96 | usUfsuCfaCfuCfaUfcacUfuCfaAfaAfusGfsc | 2189-2211 |
| 3375 | 3376 | AD-58850 | AfsgsUfuAfuAfuUfAfAfaUfuUfuAfaUfcUfL96 | asGfsaUfuAfaAfaUfuuaAfuAfuAfaCfusUfsa | 2344-2366 |
| 3377 | 3378 | AD-58851 | GfscsAfuUfuUfgAfAfGfuGfaUfgAfgUfgAfL96 | usCfsaCfuCfaUfcAfcuuCfaAfaAfuGfcsAfsg | 2187-2209 |
| 3379 | 3380 | AD-58852 | GfsasAfcUfaAfuGfAfGfcAfgAfcAfuAfaCfL96 | gsUfsuAfuGfuCfuGfcucAfuUfaGfuUfcsAfsu | 1975-1997 |
| 3381 | 3382 | AD-58853 | AfsasUfgAfcCfaCfAfCfcUfaUfcGfaGfuUfL96 | asAfscUfcGfaUfaGfgugUfgGfuCfaUfusCfsu | 973-995 |
| 3383 | 3384 | AD-58854 | UfsasAfaUfuUfuAfAfAfUfcUfaUfaGfuAfaAfL96 | usUfsuAfcUfaUfaGfauuAfaAfaUfuUfasAfsu | 2352-2374 |
| 3385 | 3386 | AD-58855 | UfsusCfaGfuAfuGfAfUfcGfuUfuCfuUfuGfL96 | csAfsaAfgAfaAfcGfaucAfuAfcUfgAfasAfsa | 929-951 |
| 3387 | 3388 | AD-58856 | CfsasCfuUfuUfcAfGfUfaUfgAfucCfgUfuUfL96 | asAfsaCfgAfuCfaUfacuGfaAfaAfgUfgsGfsa | 924-946 |
| 3389 | 3390 | AD-58857 | AfsasAfuCfuGfuUfUfCfcAfcUfuUfuCfaGfL96 | csUfsgAfaAfaGfuGfgaaAfcAfgAfuUfusUfsg | 913-935 |
| 3391 | 3392 | AD-58858 | CfsasUfuUfgAfaAfCfUfgUfcCfaUfuCfaAfL96 | usUfsgAfaUfgGfaCfaguUfuCfaAfaUfgsCfsc | 1478-1500 |
| 3393 | 3394 | AD-58859 | CfscsUfaUfcGfaGfUfUfuUfuAfaAfaCfuGfL96 | csAfsgUfuUfuAfaAfaacUfcGfaUfaGfgsUfsg | 983-1005 |
| 3395 | 3396 | AD-58861 | GfsasCfcAfgAfaAfGfAfgUfgUfcUfcAfuCfL96 | gsAfsuGfaGfaCfaCfucuUfcUfgGfuUfcsUfsu | 872-894 |
| 3397 | 3398 | AD-58862 | AfscsCfaGfaAfaGfAfGfuGfuCfuCfaUfcUfL96 | asGfsaUfgAfgAfcAfcucUfuUfcUfgGfusCfsu | 873-895 |

TABLE 14-continued

Human ALAS1 Modified Single Strands and Duplex Sequences

| SEQ ID NO: (sense) | SEQ ID NO: (antisense) | Duplex Name | Sense Sequence (5'-3') | Antisense Sequence (5'-3') | Target sites of antisense sequence on NM_000688.4 |
|---|---|---|---|---|---|
| 3399 | 3400 | AD-58863 | AfscsUfaAfuGfaGfCfAfgAfcAfuAfaCfaAfL96 | asUfsgUfuAfuGfuCfugcUfcAfuUfaGfusUfsc | 1977-1999 |
| 3401 | 3402 | AD-58864 | UfsasGfuAfaAfaAfCfAfuAfgUfcCfuGfgAfL96 | usCfscAfgGfaCfuAfuguUfuUfuAfcUfasUfsa | 2366-2388 |
| 3403 | 3404 | AD-58865 | UfsasUfuUfcUfgUfgGfAfAfcUfaGfuAfaAfuUfL96 | asAfsuUfuAfcUfaGfuucCfaGfaAfaUfasUfsu | 1185-1207 |
| 3405 | 3406 | AD-58867 | UfsusCfuGfcAfaAfGfCfcAfgUfcUfuGfaGfL96 | csUfscAfaGfaCfuGfgcuUfuGfcAfgAfasGfsa | 706-728 |
| 3407 | 3408 | AD-58868 | GfsasGfaAfaGfaGfGfuUfgCfuGfaAfaCfL96 | gsUfsuUfcAfgCfaAfccuCfuUfuCfcUfcsAfsc | 759-781 |
| 3409 | 3410 | AD-58869 | GfsgsUfaCfuAfgAfAfAfuAfuUfuCfuGfgAfL96 | usCfscAfgAfaAfuAfuuuCfuAfgUfaCfcsAfsc | 1174-1196 |
| 3411 | 3412 | AD-58870 | GfsasCfaUfcAfuGfCfAfaAfaGfcAfaAfgAfL96 | usCfsuUfuGfcUfuUfugcAfuGfaUfgUfcsCfsu | 853-875 |
| 3413 | 3414 | AD-58871 | AfsasAfuUfuUfaAfUfCfuAfuAfgUfaAfaAfL96 | usUfsuUfaCfuAfuAfgauUfaAfaAfuUfusAfsa | 2353-2375 |
| 3415 | 3416 | AD-58873 | CfsasUfgAfuCfcAfAfGfgGfaUfuCfgAfaAfL96 | usUfsuCfgAfaUfcCfcuuGfgAfuCfaUfgsGfsa | 1362-1384 |
| 3417 | 3418 | AD-58874 | AfsgsAfcCfaGfaAfAfGfaGfuGfuCfuCfaUfL96 | asUfsgAfgAfcAfcUfcuuUfcUfgGfuCfusUfsu | 871-893 |
| 3419 | 3420 | AD-58875 | AfsusCfUfgAfaGfAfGfcGfcUfgAfgGfaAfL96 | usCfscCfuCfaGfcGfcucUfuCfaGfaUfusCfsc | 1810-1832 |
| 3421 | 3422 | AD-58876 | GfsusCfuGfuGfaUfGfAfaCfuAfaUfgAfgCfL96 | gsCfsuCfaUfuAfgUfucaUfcAfcAfgAfcsUfsu | 1966-1988 |
| 3423 | 3424 | AD-58877 | CfsasGfaAfaGfaGfUfGfuCfuCfaUfcUfuCfL96 | gsAfsaGfaUfgAfgAfcacUfcUfuUfcUfgsGfsu | 875-897 |
| 3425 | 3426 | AD-58878 | AfscsUfuUfcCfaGfUfaUfuGfaUfcGfuUfcCfL96 | gsAfsaAfcGfaUfcAfuacUfgAfaAfaGfusGfsg | 925-947 |
| 3427 | 3428 | AD-58879 | UfscsAfuGfcCfaAfAfaUfgGfaCfa UfcAfL96 | usGfsaUfgUfcCfaUfuuuUfgGfcAfuGfasCfsu | 1634-1656 |
| 3429 | 3430 | AD-58880 | AfsasUfaUfuUfcUfGfGfaAfcUfaGfuAfaAfL96 | usUfsuAfcUfaGfuUfccaGfaAfaUfaUfusUfsc | 1183-1205 |
| 3431 | 3432 | AD-58881 | CfsusUfcUfcUfaAfGfAfuAfaCfuUfgCfcAfL96 | usGfsgCfaAfgUfuAfucuUfaGfaGfaAfgsAfsu | 892-914 |
| 3433 | 3434 | AD-58882 | UfsusUfcAfgUfaUfGfGfAfuCfgUfuUfcUfuUfL96 | asAfsaGfaAfaCfgAfucaUfaCfuGfaAfasAfsg | 928-950 |
| 3435 | 3436 | AD-58883 | CfscsCfaGfuGfuGfGfUfuAfgUfgUfgAfaAfL96 | usUfsuCfaCfaCfuAfaccAfcAfcUfgGfgsGfsc | 790-812 |
| 3437 | 3438 | AD-58884 | GfscsUfgUfgAfgAfUfUfuAfcUfcUfgAfuUfL96 | asAfsuCfaGfaGfuAfaauCfuCfaCfaGfcsCfsu | 1325-1347 |
| 3439 | 3440 | AD-58885 | AfsgsGfcUfgUfgaGfCfAfaGfuUfgGfuAfuCfL96 | gsAfsuAfcCfaAfcUfugcUfcAfcAfgCfcsCfsa | 2229-2251 |
| 3441 | 3442 | AD-58886 | GfsasAfaGfaGfuGfUfCfuCfaUfcUfL96 | asAfsgAfgAfuGfAfgacAfcUfcUfuUfcsUfsg | 877-899 |
| 3443 | 3444 | AD-58887 | AfsusUfcUfgAfgAfAfCfuAfgUfaAfaUfcUfL96 | gsAfsaUfuUfaCfuAfguuCfuCfaGfaAfusAfsu | 1186-1208 |
| 3445 | 3446 | AD-58888 | UfsgsUfgAfuGfuGfGfCfcCfaUfgAfgUfuUfL96 | asAfsaCfuCfaUfgGfgccAfcAfuCfaCfasCfsa | 1531-1553 |

TABLE 14-continued

Human ALAS1 Modified Single Strands and Duplex Sequences

| SEQ ID NO: (sense) | SEQ ID NO: (antisense) | Duplex Name | Sense Sequence (5'-3') | Antisense Sequence (5'-3') | Target sites of antisense sequence on NM_000688.4 |
|---|---|---|---|---|---|
| 3447 | 3448 | AD-58889 | AfsasGfaGfaGfaAfGfUfcCfuAfuUfuCfuCfL96 | gsAfsgAfaAfuAfgGfacuUfcUfcUfcUfusUfsc | 2208-2230 |
| 3449 | 3450 | AD-58890 | UfsgsGfcAfgCfaCfAfGfaUfgAfaUfcAfgAfL96 | usCfsuGfaUfcCfaUfcugUfgCfuGfcCfasGfsg | 671-693 |
| 3451 | 3452 | AD-58891 | AfsusGfaUfcGfuUfUfCfuUfuGfaGfaAfaAfL96 | usUfsuUfcUfcAfaAfgaaAfcGfaUfcAfusAfsc | 935-957 |
| 3453 | 3454 | AD-58892 | UfscsUfgGfaAfcUfAfGfuAfaAfuUfcCfaUfL96 | asUfsgGfaAfuUfuAfcuaGfuUfcCfaGfasAfsa | 1189-1211 |
| 3455 | 3456 | AD-59095 | GfscsCfcAfuUfcUfUfAfuCfcCfgAfgUfL96 | asCfsuCfgGfgAfuAfagaAfuGfgsgsc | 360-382 |
| 3457 | 3458 | AD-59096 | GfsgsAfaCfcAfuGfCfCfuCfcAfuGfaUfL96 | asUfscAfuGfaAfgGfcauGfuGfuscsc | 1347-1369 |
| 3459 | 3460 | AD-59097 | UfsgsGfaGfuCfuGfUfGfcGfgAfuCfcUfL96 | asGfsgAfuCfcGfcAfcagAfcUfcscsa | 1794-1816 |
| 3461 | 3462 | AD-59098 | CfsasCfcCfaCfgGfGfUfgUfgUfgGfgAfL96 | usCfscCfaCfaCfaCfccgUfgGfgsusg | 1112-1134 |
| 3463 | 3464 | AD-59099 | GfsgsAfgUfcUfgUfGfCfgGfaUfcCfuAfL96 | usAfsgGfaUfcCfgCfacaGfaCfuscsc | 1795-1817 |
| 3465 | 3466 | AD-59100 | CfsasAfaAfcUfgCfFfCfcAfaGfaUfgAfL96 | usCfsaUfcUfuGfgGfcaGfuUfususg | 428-450 |
| 3467 | 3468 | AD-59101 | GfscsCfuCfcAfuGfAfUfcCfaAfgGfgAfL96 | usCfscCfuUfgGfaUfcauGfgAfgsgsc | 1355-1377 |
| 3469 | 3470 | AD-59102 | CfsasUfcAfuCfcCfUfGfuGfcGfgGfuUfL96 | asAfscCfcGfcAfcAfgggAfuGfasusg | 1921-1943 |
| 3471 | 3472 | AD-59103 | AfscsCfcAfcGfgGfUfGfuGfuGfgGfgAfL96 | usCfscCfcAfcAfcAfcccGfuGfgsgsu | 1113-1135 |
| 3473 | 3474 | AD-59104 | CfsasCfaUfcAfuCfCfCfuGfuGfcGfgAfL96 | usCfscGfcAfcAfgGfgauGfaUfgsusg | 1919-1941 |
| 3475 | 3476 | AD-59105 | CfsasGfaAfaGfaGfUfGfuCfuCfaUfcUfL96 | asGfsaUfgAfgAfcAfcucUfuUfcsusg | 873-895 |
| 3477 | 3478 | AD-59106 | CfscsUfcCfaUfgAfUfCfcAfaGfgGfaUfL96 | asUfscCfcUfuGfgAfucaUfgGfasgsg | 1356-1378 |
| 3479 | 3480 | AD-59107 | UfsgsCfcCfaUfuCfUfUfaUfcCfcGfaAfL96 | usUfscGfgGfaUfaAfgaaUfgGfscsa | 359-381 |
| 3481 | 3482 | AD-59108 | CfsusUfcAfcCfcUfGfGfgCfuAfaFgAfuAfL96 | usAfsuCfuUfaGfcCfaggGfuGfasasg | 1297-1319 |
| 3483 | 3484 | AD-59109 | AfsusCfaUfcCfcUfGfUfgCfgGfgUfuAfL96 | usAfsaCfcCfgCfaCfaggGfaUfgsasu | 1922-1944 |
| 3485 | 3486 | AD-59110 | AfsgsAfaAfgAfgUfGfUfcUfcAfuCfuUfL96 | asAfsgAfuGfaGfaCfacuCfuUfuscsu | 874-896 |
| 3487 | 3488 | AD-59111 | CfsusCfcAfuGfaUfCfCfaAfgGfgAfuUfL96 | asAfsuCfcCfuUfgGfaucAfuGfgsasg | 1357-1379 |
| 3489 | 3490 | AD-59112 | CfscsAfuUfcUfuAfUfCfcCfgAfgUfcAfL96 | usGfsaCfuCfgGfgAfuaaGfaAfusgsg | 362-384 |
| 3491 | 3492 | AD-59113 | CfsasCfcCfuGfgCfUfAfaGfaUfgAfuAfL96 | usAfsuCfaUfcUfuAfgccAfgGfgsusg | 1300-1322 |

TABLE 14-continued

Human ALAS1 Modified Single Strands and Duplex Sequences

| SEQ ID NO: (sense) | SEQ ID NO: (anti-sense) | Duplex Name | Sense Sequence (5'-3') | Antisense Sequence (5'-3') | Target sites of antisense sequence on NM_000688.4 |
|---|---|---|---|---|---|
| 3493 | 3494 | AD-59114 | UfscsAfuCfcCfuGfUfGfcGfgGfuUfgAfL96 | usCfsaAfcCfcGfcAfcagGfgAfusgsa | 1923-1945 |
| 3495 | 3496 | AD-59115 | AfsasGfaGfuGfuCfUfCfaUfcUfuCfuUfL96 | asAfsgAfaGfaUfgAfgacAfcUfcsusu | 877-899 |
| 3497 | 3498 | AD-59116 | GfsusCfaUfgCfcAfAfAfaAfuGfgAfcAfL96 | usGfsuCfcAfuUfuUfuggCfaUfgsasc | 1631-1653 |
| 3499 | 3500 | AD-59117 | CfsasUfuCfuUfaUfCfCfcGfaGfuCfcAfL96 | usGfsgAfcUfcGfgGfauaAfgAfasusg | 363-385 |
| 3501 | 3502 | AD-59118 | AfscsCfcUfgGfcUfAfAfgAfuGfaUfgAfL96 | usCfsaUfcAfuCfuUfagcCfaGfgsgsu | 1301-1323 |
| 3503 | 3504 | AD-59119 | CfsusCfuUfcAfcCfCfUfgGfcUfaAfgAfL96 | usCfsuUfaGfcCfaGfgguGfaAfgsasg | 1295-1317 |
| 3505 | 3506 | AD-59120 | AfsusGfcCfaAfaAfAfUfgGfaCfaUfcAfL96 | usGfsaUfgUfcCfaUfuuuUfgGfcsasu | 1634-1656 |
| 3507 | 3508 | AD-59121 | UfsgsCfcCfcAfaGfAfUfgAfuGfgAfaUfL96 | asUfsuCfcAfuCfaUfcuuGfgGfscsa | 434-456 |
| 3509 | 3510 | AD-59122 | GfsasAfcCfaUfgCfCfUfcCfaUfgAfuAfL96 | usAfsuCfaUfgGfaGfgcaUfgGfsusuc | 1348-1370 |
| 3511 | 3512 | AD-59123 | UfscsUfcCfaCfcCfUfGfgCfuAfaGfaUfL96 | asUfscUfuAfgCfcAfgggUfgAfasgsa | 1296-1318 |
| 3513 | 3514 | AD-59124 | UfsgsCfcAfaAfaAfUfGfgAfcAfuCfaUfL96 | asUfsgAfuGfuCfcAfuuuUfuGfgscsa | 1635-1657 |
| 3515 | 3516 | AD-59125 | CfscsAfgAfaAfgAfGfUfgUfcUfcAfuUfL96 | usAfsuGfaGfaCfaCfucuUfuCfusgsg | 872-894 |
| 3517 | 3518 | AD-59126 | GfsasAfaCfuGfuCfCfCfAfuUfcAfaUfgAfL96 | usCfsaUfuGfaAfuGfgacAfgUfususc | 1481-1503 |
| 3519 | 3520 | AD-59127 | UfscsAfcCfcUfgGfCfUfaAfgAfuGfaUfL96 | asUfscAfuCfuUfaGfccaGfgGfusgsa | 1299-1321 |
| 3521 | 3522 | AD-59128 | CfscsCfuGfgAfgUfCfUfgUfgCfgGfaUfL96 | asUfscCfgCfaCfaGfacuCfcAfgsgsg | 1791-1813 |
| 3523 | 3524 | AD-59129 | GfsasAfaGfaGfuGfUfCfuCfaUfcUfuAfL96 | usAfsaGfaUfgAfgAfcacUfcUfususc | 875-897 |
| 3525 | 3526 | AD-59130 | UfsgsGfaGfcCfcUfGfGfaGfuCfuGfuAfL96 | usAfscAfgAfcUfcCfaggGfcUfcscsa | 1786-1808 |

TABLE 15

Human ALAS1 Unmodified Single Strands and Duplex Sequences

| SEQ ID NO: (sense) | SEQ ID NO: (anti-sense) | Duplex Name | Sense Sequence (5'-3') | Antisense Sequence (5'-3') | Target sites of antisense sequence on NM_000688.4 |
|---|---|---|---|---|---|
| 3684 | 3527 | AD-58848 | CAUGCCAAAAAUGGACAUCAU | AUGAUGUCCAUUUUUGGCAUGAC | 1635-1657 |
| 3528 | 3529 | AD-58849 | AUUUUGAAGUGAUGAGUGAAA | UUUCACUCAUCACUUCAAAAUGC | 2189-2211 |
| 3530 | 3531 | AD-58850 | AGUUAUAUUAAAUUUUAAUCU | AGAUUAAAAUUUAAUAUAACUUA | 2344-2366 |

TABLE 15-continued

Human ALAS1 Unmodified Single Strands and Duplex Sequences

| SEQ ID NO: (sense) | SEQ ID NO: (anti-sense) | Duplex Name | Sense Sequence (5'-3') | Antisense Sequence (5'-3') | Target sites of antisense sequence on NM_000688.4 |
|---|---|---|---|---|---|
| 3532 | 3533 | AD-58851 | GCAUUUGAAGUGAUGAGUGA | UCACUCAUCACUUCAAAAUGCAG | 2187-2209 |
| 3534 | 3535 | AD-58852 | GAACUAAUGAGCAGACAUAAC | GUUAUGUCUGCUCAUUAGUUCAU | 1975-1997 |
| 3536 | 3537 | AD-58853 | AAUGACCACACCUAUCGAGUU | AACUCGAUAGGUGUGGUCAUUCU | 973-995 |
| 3538 | 3539 | AD-58854 | UAAAUUUUAAUCUAUAGUAAA | UUUACUAUAGAUUAAAAUUUAAU | 2352-2374 |
| 3540 | 3541 | AD-58855 | UUCAGUAUGAUCGUUUCUUUG | CAAAGAAACGAUCAUACUGAAAA | 929-951 |
| 3542 | 3543 | AD-58856 | CACUUUUCAGUAUGAUCGUUU | AAACGAUCAUACUGAAAAGUGGA | 924-946 |
| 3544 | 3545 | AD-58857 | AAAUCUGUUUCCACUUUUCAG | CUGAAAAGUGGAAACAGAUUUUG | 913-935 |
| 3546 | 3547 | AD-58858 | CAUUUGAAACUGUCCAUUCAA | UUGAAUGGACAGUUUCAAAUGCC | 1478-1500 |
| 3548 | 3549 | AD-58859 | CCUAUCGAGUUUUUAAAACUG | CAGUUUUAAAAACUCGAUAGGU | 983-1005 |
| 3550 | 3551 | AD-58861 | GACCAGAAAGAGUGUCUCAUC | GAUGAGACACUCUUUCUGGUCUU | 872-894 |
| 3552 | 3553 | AD-58862 | ACCAGAAAGAGUGUCUCAUCU | AGAUGAGACACUCUUUCUGGUCU | 873-895 |
| 3554 | 3555 | AD-58863 | ACUAAUGAGCAGACAUAACAU | AUGUUAUGUCUGCUCAUUAGUUC | 1977-1999 |
| 3556 | 3557 | AD-58864 | UAGUAAAAACAUAGUCCUGGA | UCCAGGACUAUGUUUUUACUAUA | 2366-2388 |
| 3558 | 3559 | AD-58865 | UAUUUCUGGAACUAGUAAAUU | AAUUUACUAGUUCCAGAAAUAUU | 1185-1207 |
| 3560 | 3561 | AD-58867 | UUCUGCAAAGCCAGUCUUGAG | CUCAAGACUGGCUUUGCAGAAGA | 706-728 |
| 3562 | 3563 | AD-58868 | GAGGAAAGAGGUUGCUGAAAC | GUUUCAGCAACCUCUUUCCUCAC | 759-781 |
| 3564 | 3565 | AD-58869 | GGUACUAGAAAUAUUUCUGGA | UCCAGAAAUAUUUCUAGUACCAC | 1174-1196 |
| 3566 | 3567 | AD-58870 | GACAUCAUGCAAAAGCAAAGA | UCUUUGCUUUUGCAUGAUGUCCU | 853-875 |
| 3568 | 3569 | AD-58871 | AAAUUUUAAUCUAUAGUAAAA | UUUUACUAUAGAUUAAAAUUUAA | 2353-2375 |
| 3570 | 3571 | AD-58873 | CAUGAUCCAAGGGAUUCGAAA | UUUCGAAUCCCUUGGAUCAUGGA | 1362-1384 |
| 3572 | 3573 | AD-58874 | AGACCAGAAAGAGUGUCUCAU | AUGAGACACUCUUUCUGGUCUUU | 871-893 |
| 3574 | 3575 | AD-58875 | AUCCUGAAGAGCGCUGAGGGA | UCCCUCAGCGCUCUUCAGGAUCC | 1810-1832 |
| 3576 | 3577 | AD-58876 | GUCUGUGAUGAACUAAUGAGC | GCUCAUUAGUUCAUCACAGACUU | 1966-1988 |
| 3578 | 3579 | AD-58877 | CAGAAAGAGUGUCUCAUCUUC | GAAGAUGAGACACUCUUUCUGG | 875-897 |
| 3580 | 3581 | AD-58878 | ACUUUCAGUAUGAUCGUUUC | GAAACGAUCAUACUGAAAAGUGG | 925-947 |
| 3582 | 3583 | AD-58879 | UCAUGCCAAAAAUGGACAUCA | UGAUGUCCAUUUUUGGCAUGACU | 1634-1656 |
| 3584 | 3585 | AD-58880 | AAUAUUUCUGGAACUAGUAAA | UUUACUAGUUCCAGAAAUAUUUC | 1183-1205 |
| 3586 | 3587 | AD-58881 | CUUCUUCAAGAUAACUUGCCA | UGGCAAGUUAUCUUGAAGAAGAU | 892-914 |
| 3588 | 3589 | AD-58882 | UUUCAGUAUGAUCGUUUCUUU | AAAGAAACGAUCAUACUGAAAG | 928-950 |
| 3590 | 3591 | AD-58883 | CCCAGUGUGGUUAGUGUGAAA | UUUCACACUAACCACACUGGGGC | 790-812 |
| 3592 | 3593 | AD-58884 | GCUGUGAGAUUUACUCUGAUU | AAUCAGAGUAAAUCUCACAGCCU | 1325-1347 |
| 3594 | 3595 | AD-58885 | AGGCUUGAGCAAGUUGGUAUC | GAUACCAACUUGCUCAAGCCUGA | 2229-2251 |
| 3596 | 3597 | AD-58886 | GAAAGAGUGUCUCAUCUUCUU | AAGAAGAUGAGACACUCUUUCUG | 877-899 |
| 3598 | 3599 | AD-58887 | AUUUCUGGAACUAGUAAAUUC | GAAUUUACUAGUUCCAGAAAUAU | 1186-1208 |
| 3600 | 3601 | AD-58888 | UGUGAUGUGGCCCAUGAGUUU | AAACUCAUGGGCCACAUCACACA | 1531-1553 |

TABLE 15-continued

Human ALAS1 Unmodified Single Strands and Duplex Sequences

| SEQ ID NO: (sense) | SEQ ID NO: (anti-sense) | Duplex Name | Sense Sequence (5'-3') | Antisense Sequence (5'-3') | Target sites of antisense sequence on NM_000688.4 |
|---|---|---|---|---|---|
| 3602 | 3603 | AD-58889 | AAGAGAGAAGUCCUAUUUCUC | GAGAAAUAGGACUUCUCUCUUUC | 2208-2230 |
| 3604 | 3605 | AD-58890 | UGGCAGCACAGAUGAAUCAGA | UCUGAUUCAUCUGUGCUGCCAGG | 671-693 |
| 3606 | 3607 | AD-58891 | AUGAUCGUUUCUUUGAGAAAA | UUUUCUCAAAGAAACGAUCAUAC | 935-957 |
| 3608 | 3609 | AD-58892 | UCUGGAACUAGUAAAUUCCAU | AUGGAAUUUACUAGUUCCAGAAA | 1189-1211 |
| 3610 | 3611 | AD-59095 | GCCCAUUCUUAUCCCGAGU | ACUCGGGAUAAGAAUGGGC | 360-382 |
| 3612 | 3613 | AD-59096 | GGAACCAUGCCUCCAUGAU | AUCAUGGAGGCAUGGUUCC | 1347-1369 |
| 3614 | 3615 | AD-59097 | UGGAGUCUGUGCGGAUCCU | AGGAUCCGCACAGACUCCA | 1794-1816 |
| 3616 | 3617 | AD-59098 | CACCCACGGGUGUGUGGGA | UCCCACACACCCGUGGGUG | 1112-1134 |
| 3618 | 3619 | AD-59099 | GGAGUCUGUGCGGAUCCUA | UAGGAUCCGCACAGACUCC | 1795-1817 |
| 3620 | 3621 | AD-59100 | CAAAACUGCCCCAAGAUGA | UCAUCUUGGGGCAGUUUUG | 428-450 |
| 3622 | 3623 | AD-59101 | GCCUCCAUGAUCCAAGGGA | UCCCUUGGAUCAUGGAGGC | 1355-1377 |
| 3624 | 3625 | AD-59102 | CAUCAUCCCUGUGCGGGUU | AACCCGCACAGGGAUGAUG | 1921-1943 |
| 3626 | 3627 | AD-59103 | ACCCACGGGUGUGUGGGGA | UCCCCACACACCCGUGGGU | 1113-1135 |
| 3628 | 3629 | AD-59104 | CACAUCAUCCCUGUGCGGA | UCCGCACAGGGAUGAUGUG | 1919-1941 |
| 3630 | 3631 | AD-59105 | CAGAAAGAGUGUCUCAUCU | AGAUGAGACACUCUUUCUG | 873-895 |
| 3632 | 3633 | AD-59106 | CCUCCAUGAUCCAAGGGAU | AUCCCUUGGAUCAUGGAGG | 1356-1378 |
| 3634 | 3635 | AD-59107 | UGCCCAUUCUUAUCCCGAA | UUCGGGAUAAGAAUGGGCA | 359-381 |
| 3636 | 3637 | AD-59108 | CUUCACCCUGGCUAAGAUA | UAUCUUAGCCAGGGUGAAG | 1297-1319 |
| 3638 | 3639 | AD-59109 | AUCAUCCCUGUGCGGGUUA | UAACCCGCACAGGGAUGAU | 1922-1944 |
| 3640 | 3641 | AD-59110 | AGAAAGAGUGUCUCAUCUU | AAGAUGAGACACUCUUUCU | 874-896 |
| 3642 | 3643 | AD-59111 | CUCCAUGAUCCAAGGGAUU | AAUCCCUUGGAUCAUGGAG | 1357-1379 |
| 3644 | 3645 | AD-59112 | CCAUUCUUAUCCCGAGUCA | UGACUCGGGAUAAGAAUGG | 362-384 |
| 3646 | 3647 | AD-59113 | CACCCUGGCUAAGAUGAUA | UAUCAUCUUAGCCAGGGUG | 1300-1322 |
| 3648 | 3649 | AD-59114 | UCAUCCCUGUGCGGGUUGA | UCAACCCGCACAGGGAUGA | 1923-1945 |
| 3650 | 3651 | AD-59115 | AAGAGUGUCUCAUCUUCUU | AAGAAGAUGAGACACUCUU | 877-899 |
| 3652 | 3653 | AD-59116 | GUCAUGCCAAAAAUGGACA | UGUCCAUUUUUGGCAUGAC | 1631-1653 |
| 3654 | 3655 | AD-59117 | CAUUCUUAUCCCGAGUCCA | UGGACUCGGGAUAAGAAUG | 363-385 |
| 3656 | 3657 | AD-59118 | ACCCUGGCUAAGAUGAUGA | UCAUCAUCUUAGCCAGGGU | 1301-1323 |
| 3658 | 3659 | AD-59119 | CUCUUCACCCUGGCUAAGA | UCUUAGCCAGGGUGAAGAG | 1295-1317 |
| 3660 | 3661 | AD-59120 | AUGCCAAAAAUGGACAUCA | UGAUGUCCAUUUUUGGCAU | 1634-1656 |
| 3662 | 3663 | AD-59121 | UGCCCAAGAUGAUGGAAU | AUUCCAUCAUCUUGGGGCA | 434-456 |
| 3664 | 3665 | AD-59122 | GAACCAUGCCUCCAUGAUA | UAUCAUGGAGGCAUGGUUC | 1348-1370 |
| 3666 | 3667 | AD-59123 | UCUUCACCCUGGCUAAGAU | AUCUUAGCCAGGGUGAAGA | 1296-1318 |
| 3668 | 3669 | AD-59124 | UGCCAAAAAUGGACAUCAU | AUGAUGUCCAUUUUUGGCA | 1635-1657 |
| 3670 | 3671 | AD-59125 | CCAGAAAGAGUGUCUCAUA | UAUGAGACACUCUUUCUGG | 872-894 |
| 3672 | 3673 | AD-59126 | GAAACUGUCCAUUCAAUGA | UCAUUGAAUGGACAGUUUC | 1481-1503 |

TABLE 15-continued

Human ALAS1 Unmodified Single Strands and Duplex Sequences

| SEQ ID NO: (sense) | SEQ ID NO: (antisense) | Duplex Name | Sense Sequence (5'-3') | Antisense Sequence (5'-3') | Target sites of antisense sequence on NM_000688.4 |
|---|---|---|---|---|---|
| 3674 | 3675 | AD-59127 | UCACCCUGGCUAAGAUGAU | AUCAUCUUAGCCAGGGUGA | 1299-1321 |
| 3676 | 3677 | AD-59128 | CCCUGGAGUCUGUGCGGAU | AUCCGCACAGACUCCAGGG | 1791-1813 |
| 3678 | 3679 | AD-59129 | GAAAGAGUGUCUCAUCUUA | UAAGAUGAGACACUCUUUC | 875-897 |
| 3680 | 3681 | AD-59130 | UGGAGCCCUGGAGUCUGUA | UACAGACUCCAGGGCUCCA | 1786-1808 |

The results of the in vitro assays are provided in Table 16.
Table 16 also notes the target species of each of the siRNAs.

TABLE 16

Results of Functional Assays

| Duplex ID | Target Species | Type | Cyno Free Uptake | | | | Cyno Transfection | | Hep3b Transfection | |
|---|---|---|---|---|---|---|---|---|---|---|
| | | | 1 uM Avg | 500 nM Avg | 20 nM Avg | 10 nM | 20 nM Avg | 0.2 nM Avg | 10 nM Avg | 0.1 nM Avg |
| AD-58848 | M/R/Rh/H | 21/23 | 131.6 | 176.0 | 104.4 | 128.0 | 43.5 | 44.8 | 25.3 | 76.8 |
| AD-58849 | H/Rh | 21/23 | 91.9 | 88.1 | 92.2 | 105.0 | 29.4 | 35.4 | 11.5 | 47.1 |
| AD-58850 | H/Rh | 21/23 | 79.4 | 103.4 | 80.0 | 111.2 | NA | 62.2 | 31.3 | 72.0 |
| AD-58851 | H/Rh | 21/23 | 99.7 | 74.7 | 94.8 | 104.7 | NA | 40.7 | 8.6 | 81.3 |
| AD-58852 | H/Rh | 21/23 | 108.1 | 91.8 | 103.3 | 111.9 | 101.1 | 128.8 | 43.4 | 129.0 |
| AD-58853 | H/Rh | 21/23 | 74.8 | 67.7 | 84.2 | 93.5 | 24.7 | 52.9 | 14.1 | 61.2 |
| AD-58854 | H/Rh | 21/23 | 145.9 | 124.1 | 106.6 | 115.3 | 119.0 | 83.9 | 85.0 | 84.0 |
| AD-58855 | H/Rh | 21/23 | 81.5 | 97.9 | 92.7 | 101.8 | 39.5 | 40.3 | 15.3 | 67.6 |
| AD-58856 | H/Rh | 21/23 | 74.1 | 90.6 | 84.6 | 82.6 | 22.4 | 30.7 | 8.7 | 33.3 |
| AD-58857 | H/Rh | 21/23 | 64.7 | 91.4 | 62.3 | 87.1 | 22.0 | 31.6 | 9.8 | 106.3 |
| AD-58858 | H/Rh | 21/23 | 67.4 | 91.7 | 68.6 | 98.3 | 27.9 | 40.3 | 17.4 | 44.8 |
| AD-58859 | H/Rh | 21/23 | 71.2 | 77.2 | 92.4 | 90.1 | 19.1 | 34.3 | 13.1 | 39.7 |
| AD-58861 | H/Rh | 21/23 | 104.6 | 107.2 | 102.0 | 100.6 | 25.9 | 35.1 | 18.0 | 69.8 |
| AD-58862 | H/Rh | 21/23 | 66.8 | 77.0 | 68.7 | 88.5 | 20.3 | 31.1 | 24.2 | 49.9 |
| AD-58863 | H/Rh | 21/23 | 70.8 | 66.8 | 76.8 | 98.5 | 21.5 | 29.7 | 8.7 | 54.9 |
| AD-58864 | H/Rh | 21/23 | 76.2 | 85.6 | 83.7 | 100.8 | 60.4 | 61.0 | 56.4 | 87.3 |
| AD-58865 | H/Rh | 21/23 | 67.9 | 77.9 | 95.9 | 98.4 | 21.3 | 38.6 | 15.5 | 81.4 |
| AD-58867 | H/Rh | 21/23 | 95.9 | 93.3 | 107.0 | 97.5 | 32.3 | 42.7 | 16.6 | 79.8 |
| AD-58868 | H/Rh | 21/23 | 95.2 | 92.1 | 116.2 | 94.7 | 54.6 | 69.2 | 61.5 | 105.9 |
| AD-58869 | H/Rh | 21/23 | 65.0 | 78.2 | 75.8 | 88.2 | 17.4 | 25.0 | 13.0 | 63.9 |
| AD-58870 | H/Rh | 21/23 | 69.4 | 92.3 | 81.0 | 88.1 | 29.2 | 43.8 | 33.7 | 79.1 |
| AD-58871 | H/Rh | 21/23 | 61.2 | 77.3 | 88.2 | 77.0 | 71.2 | 73.2 | 36.7 | 110.3 |
| AD-58873 | H/Rh | 21/23 | 95.2 | 100.9 | 83.3 | 94.6 | 54.2 | 52.8 | 36.6 | 73.3 |
| AD-58874 | H/Rh | 21/23 | 75.8 | 76.8 | 63.8 | 85.3 | 22.3 | 31.2 | 15.0 | 38.2 |
| AD-58875 | H/Rh | 21/23 | 80.7 | 88.7 | 78.6 | 97.9 | 48.6 | 73.6 | 61.2 | 90.6 |
| AD-58876 | H/Rh | 21/23 | 90.8 | 93.1 | 82.5 | 100.2 | 41.1 | 56.9 | 21.2 | 58.7 |
| AD-58877 | H/Rh | 21/23 | 68.3 | 85.1 | 51.2 | 78.7 | 18.5 | 46.6 | 11.9 | 27.4 |
| AD-58878 | H/Rh | 21/23 | 78.3 | 68.3 | 81.2 | 91.2 | 24.1 | 23.4 | 6.2 | 37.1 |
| AD-58879 | H/Rh | 21/23 | 87.9 | 94.1 | 79.7 | 95.4 | 32.0 | 47.8 | 15.7 | 82.5 |
| AD-58880 | H/Rh | 21/23 | 74.9 | 72.2 | 88.9 | 88.1 | 20.1 | 27.5 | 14.0 | 60.7 |
| AD-58881 | H/Rh | 21/23 | 85.9 | 76.8 | 78.8 | 118.0 | 22.2 | 36.7 | 27.6 | 71.6 |
| AD-58882 | H/Rh | 21/23 | 54.1 | 53.4 | 60.3 | 85.8 | 14.6 | 27.2 | 8.2 | 23.8 |
| AD-58883 | H/Rh | 21/23 | 80.4 | 69.9 | 75.7 | 80.3 | 31.8 | 25.8 | 12.3 | 63.0 |
| AD-58884 | H/Rh | 21/23 | 57.7 | 55.3 | 64.8 | 78.2 | 20.0 | 30.0 | 11.8 | 68.9 |
| AD-58885 | H/Rh | 21/23 | 101.8 | 91.8 | 104.1 | 101.5 | 85.9 | 71.9 | 61.8 | 71.2 |
| AD-58886 | M/R/Rh/H | 21/23 | 47.1 | 58.0 | 36.3 | 93.3 | 16.0 | 26.6 | 9.2 | 32.0 |
| AD-58887 | H/Rh | 21/23 | 73.6 | 98.7 | 82.6 | 95.2 | 28.5 | 33.5 | 12.8 | 65.2 |
| AD-58888 | H/Rh | 21/23 | 90.2 | 69.9 | 69.4 | 85.6 | 46.9 | 45.0 | 16.6 | 72.0 |
| AD-58889 | H/Rh | 21/23 | 83.6 | 98.6 | 82.4 | 92.2 | 36.5 | 40.3 | 31.6 | 99.4 |
| AD-58890 | H/Rh | 21/23 | 69.5 | 95.4 | 84.2 | 88.2 | 50.8 | 45.6 | 21.7 | 92.9 |
| AD-58891 | H/Rh | 21/23 | 62.8 | 75.7 | 75.4 | 109.2 | 23.6 | 34.3 | 15.6 | 55.8 |
| AD-58892 | H/Rh | 21/23 | 60.2 | 92.9 | 89.8 | 92.9 | 22.8 | 43.3 | 20.2 | 75.6 |
| AD-59095 | M/R/Rh/H | 19mer | 88.9 | NA | 132.8 | NA | 48.3 | 97.4 | 54.3 | 99.0 |

TABLE 16-continued

Results of Functional Assays

| | | | Cyno Free Uptake | | | Cyno Transfection | | Hep3b Transfection | |
|---|---|---|---|---|---|---|---|---|---|
| Duplex ID | Target Species | Type | 1 uM Avg | 500 nM | 20 nM Avg | 10 nM | 20 nM Avg | 0.2 nM Avg | 10 nM Avg | 0.1 nM Avg |
|---|---|---|---|---|---|---|---|---|---|
| AD-59096 | M/R/Rh/H | 19mer | 95.5 | NA | 90.5 | NA | 105.7 | 138.6 | 131.4 | 120.7 |
| AD-59097 | M/R/Rh/H | 19mer | 92.5 | NA | 84.2 | NA | 75.0 | NA | 94.7 | 108.5 |
| AD-59098 | M/R/Rh/H | 19mer | 84.0 | NA | 87.7 | NA | 109.3 | NA | 130.0 | 87.3 |
| AD-59099 | M/R/Rh/H | 19mer | 89.7 | NA | 90.0 | NA | 77.8 | 85.4 | 46.8 | 74.9 |
| AD-59100 | M/R/Rh/H | 19mer | 84.8 | NA | 144.3 | NA | 70.6 | 108.1 | 91.5 | 117.6 |
| AD-59101 | M/R/Rh/H | 19mer | 79.0 | NA | 103.8 | NA | 89.8 | 102.9 | 124.2 | 107.0 |
| AD-59102 | M/R/Rh/H | 19mer | 85.9 | NA | 100.6 | NA | 72.2 | 68.5 | 87.9 | 95.1 |
| AD-59103 | M/R/Rh/H | 19mer | 86.0 | NA | 91.1 | NA | 93.0 | 81.3 | 130.0 | 96.0 |
| AD-59104 | M/R/Rh/H | 19mer | 92.6 | NA | 96.9 | NA | 94.9 | 91.4 | 124.4 | 83.1 |
| AD-59105 | M/R/Rh/H | 19mer | 48.9 | NA | 101.7 | NA | 18.4 | 48.9 | 17.0 | 34.7 |
| AD-59106 | M/R/Rh/H | 19mer | 63.2 | NA | 76.7 | NA | 28.5 | 40.7 | 28.6 | 46.4 |
| AD-59107 | M/R/Rh/H | 19mer | 71.4 | NA | 68.7 | NA | 37.1 | 45.3 | 26.8 | 63.6 |
| AD-59108 | M/R/Rh/H | 19mer | 70.7 | NA | 85.1 | NA | 89.9 | 84.8 | 139.2 | 101.7 |
| AD-59109 | M/R/Rh/H | 19mer | 86.1 | NA | 83.4 | NA | 84.9 | 96.2 | 131.7 | 86.7 |
| AD-59110 | M/R/Rh/H | 19mer | 70.8 | NA | 119.7 | NA | 38.5 | 60.4 | 67.4 | 80.3 |
| AD-59111 | M/R/Rh/H | 19mer | 66.1 | NA | 76.5 | NA | 52.2 | 61.0 | 69.7 | 87.6 |
| AD-59112 | M/R/Rh/H | 19mer | 71.2 | NA | 80.2 | NA | 91.2 | 83.4 | 127.4 | 89.0 |
| AD-59113 | M/R/Rh/H | 19mer | 67.0 | NA | 77.8 | NA | 49.1 | 59.0 | 66.8 | 91.4 |
| AD-59114 | M/R/Rh/H | 19mer | 81.7 | NA | 79.3 | NA | 96.3 | 88.0 | 129.6 | 72.4 |
| AD-59115 | M/R/Rh/H | 19mer | 40.4 | NA | 69.6 | NA | 19.6 | 35.7 | 9.3 | 16.9 |
| AD-59116 | M/R/Rh/H | 19mer | 72.2 | NA | 78.3 | NA | 53.5 | 77.8 | 70.1 | 107.8 |
| AD-59117 | M/R/Rh/H | 19mer | 70.7 | NA | 75.6 | NA | 75.8 | 74.9 | 129.0 | 103.5 |
| AD-59118 | M/R/Rh/H | 19mer | 68.8 | NA | 75.9 | NA | 81.4 | 82.1 | 114.1 | 89.7 |
| AD-59119 | M/R/Rh/H | 19mer | 64.9 | NA | 86.5 | NA | 85.1 | 125.1 | 122.8 | 124.8 |
| AD-59120 | M/R/Rh/H | 19mer | 63.5 | NA | 75.1 | NA | 29.9 | 52.0 | 16.1 | 54.1 |
| AD-59121 | M/R/Rh/H | 19mer | 67.6 | NA | 72.0 | NA | 88.8 | 77.4 | 108.0 | 103.1 |
| AD-59122 | M/R/Rh/H | 19mer | 60.2 | NA | 62.3 | NA | 25.1 | 45.3 | 16.2 | 54.8 |
| AD-59123 | M/R/Rh/H | 19mer | 68.6 | NA | 108.2 | NA | 59.2 | 84.6 | 80.0 | 97.7 |
| AD-59124 | M/R/Rh/H | 19mer | 47.5 | NA | 56.5 | NA | 23.9 | 40.0 | 9.8 | 18.9 |
| AD-59125 | M/R/Rh/H | 19mer | 45.4 | NA | 47.2 | NA | 15.2 | 40.7 | 14.7 | 15.1 |
| AD-59126 | M/R/Rh/H | 19mer | 64.3 | NA | 74.6 | NA | 51.6 | 57.1 | 35.5 | 54.4 |
| AD-59127 | M/R/Rh/H | 19mer | 103.4 | NA | 105.8 | NA | 94.0 | 156.4 | 135.9 | 113.7 |
| AD-59128 | M/R/Rh/H | 19mer | 102.4 | NA | 81.4 | NA | 66.3 | 89.3 | 60.2 | 74.9 |
| AD-59129 | M/R/Rh/H | 19mer | 41.3 | NA | 38.8 | NA | 17.9 | 41.4 | 8.6 | 12.6 |
| AD-59130 | M/R/Rh/H | 19mer | 58.3 | NA | 80.8 | NA | 94.9 | 78.3 | 106.7 | 88.0 |

Table 17 illustrates the $IC_{50}s$ of select ALAS1 siRNA duplexes. The $IC_{50}s$ were determined from the knockdown of endogenously expressed ALAS1 in the Hep3B cell line, at 24 hours following transfection of each ALAS1 modified siRNA duplex (see Table 14). At least seven duplexes, including AD-58882, AD-58878, AD-58886, AD-58877, AD-59115, AD-58856, and AD-59129, consistently demonstrated $IC_{50}s$ of less than 0.1 nm, indicating that these duplexes were particularly effective in suppressing ALAS1 expression.

TABLE 17

$IC_{50}s$ of select ALAS1 siRNA duplexes

| Duplex ID | 384w IC50 (nM) | 96w IC50 (nM) |
|---|---|---|
| AD-58882 | 0.008 | 0.014 |
| AD-58878 | 0.040 | 0.031 |
| AD-58886 | 0.037 | 0.033 |
| AD-58877 | 0.031 | 0.034 |
| AD-59115 | 0.093 | 0.052 |
| AD-58856 | 0.061 | 0.066 |
| AD-59129 | 0.085 | 0.071 |
| AD-59124 | 0.572 | 0.078 |
| AD-58874 | 0.140 | 0.102 |
| AD-59125 | 0.118 | 0.115 |
| AD-59105 | 0.511 | 0.144 |
| AD-59120 | 180.592 | 0.498 |
| AD-59122 | 36.646 | 0.646 |
| AD-59106 | 7.906 | 0.847 |
| AD-59126 | n/a | 1.014 |
| AD-59107 | n/a | 1.971 |

Example 11

ALAS1-GalNAc Activity in AIP Phenobarbital Induction Mouse Model

The AIP mouse model was used to investigate the effect of an siRNA that was an ALAS1-GalNAc conjugate. The siRNA had the sequence of duplex AD-58632 (see Table 20).

TABLE 20

Sequences of ALAS1 siRNA Duplex AD-58632

| SEQ ID NO: (sense) | SEQ ID NO: (antisense) | Target sites of antisense sequence on NM_000688.4 | Duplex Name | Sense Sequence (5'-3') | Antisense Sequence (5'-3') |
|---|---|---|---|---|---|
| 4149 | 4150 | 873-895 | AD-58632 | GfsasAfaGfuGfuGfUfCfuCfaUfcUfuCfuUfL96 | asAfsgAfaGfaUfgAfgacAfcUfcUfuUfcsusg |

Figure 15:
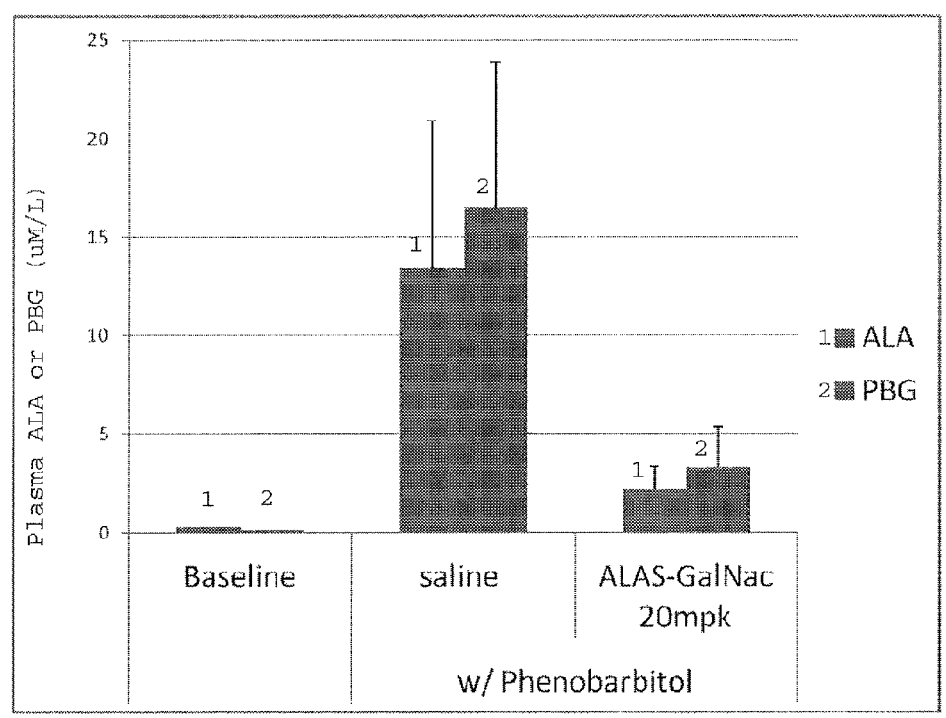
FIG. 15 shows the effects of a GalNAc conjugated ALAS1 siRNA on plasma ALA and plasma PBG levels in the mouse AIP phenobarbital induction model.

AIP mice were untreated (baseline), or injected subcutaneously on day 1 with saline or the ALAS1-GalNAc conjugate at a dose of 20 mg/kg. On Days 2, 3, and 4 they were left untreated (baseline) or they were treated with IP injections of Phenobarbital. On Day 5 plasma was taken and levels of ALA and PBG were measured using an LC-MS assay. As shown in FIG. 15, the ALAS1-GalNAc conjugate blunted the production of plasma ALA and PBG by about 84 and 80% respectively. These results indicate that treatment with an ALAS1-GalNAc conjugate was effective in preventing increases in both plasma ALA and PBG associated with phenobarbital-induced acute attacks in this AIP animal model.

Example 12

Further siRNAs that Target ALAS1 and Inhibit ALAS1 Expression

Modified siRNA sequences that target ALAS1 siRNA were designed and produced as described in Example 2. The sequences are provided in Table 18. The in vitro activity of the modified duplexes was tested as described below.

TABLE 18

Human ALAS1 Modified Single Strands and Duplex Sequences

| SEQ ID NO: (sense) | SEQ ID NO: (antisense) | Duplex Name | Sense Sequence (5'-3') | Antisense Sequence (5'-3') | Target sites of antisense sequence on NM_000688.4 |
|---|---|---|---|---|---|
| 3685 | 3686 | AD-59453 | CAGGCAAAUCUCUGUUGUUUdTdT | AACAACAGAGAUUUGCCUGdTdT | 402-420 |
| 3687 | 3688 | AD-59395 | GAAAAAAAUUGAUGAGAAAdTdT | UUUCUCAUCAAUUUUUUUCdTdT | 949-967 |
| 3689 | 3690 | AD-59477 | GGAAAGAUGCCGCACUCUUdTdT | AAGAGUGCGGCAUCUUUCCdTdT | 1242-1260 |
| 3691 | 3692 | AD-59492 | UGUCUCAUCUUCUUCAAGAdTdT | UCUUGAAGAAGAUGAGACAdTdT | 882-900 |
| 3693 | 3694 | AD-59361 | ACAUCUACGUGCAAGCAAUdTdT | AUUGCUUGCACGUAGAUGUdTdT | 1992-2010 |
| 3695 | 3696 | AD-59462 | UUCUCUGAUUGACACCGUAdTdT | UACGGUGUCAAUCAGAGAAdTdT | 1711-1729 |
| 3697 | 3698 | AD-59433 | GCUGCUGGCUUCAUCUUCAdTdT | UGAAGAUGAAGCCAGCAGCdTdT | 1739-1757 |
| 3699 | 3700 | AD-59424 | AGCGCAACGUCAAACUCAUdTdT | AUGAGUUUGACGUUGCGCUdTdT | 1851-1869 |
| 3701 | 3702 | AD-59414 | UAUUUCUGGAACUAGUAAAdTdT | UUUACUAGUUCCAGAAAUAdTdT | 1183-1201 |
| 3703 | 3704 | AD-59539 | GGUUGUGUUGGAGGGUACAdTdT | UGUACCCUCCAACACAACCdTdT | 1679-1697 |
| 3705 | 3706 | AD-59400 | GUGUCAGUCUGGUGCAGUAdTdT | UACUGCACCAGACUGACACdTdT | 1070-1088 |
| 3707 | 3708 | AD-59551 | CUUUGUGGCCAAUGACUCAdTdT | UGAGUCAUUGGCCACAAAGdTdT | 1273-1291 |
| 3709 | 3710 | AD-59482 | AGAUGCUGCUAAAAACACAdTdT | UGUGUUUUUAGCAGCAUCUdTdT | 1942-1960 |
| 3711 | 3712 | AD-59448 | GAGUCAUGCCAAAAAUGGAdTdT | UCCAUUUUUGGCAUGACUCdTdT | 1629-1647 |
| 3713 | 3714 | AD-59392 | CUGUGCGGAUCCUGAAGAGdTdT | CUCUUCAGGAUCCGCACAGdTdT | 1800-1818 |
| 3715 | 3716 | AD-59469 | CACUUUGAAACAACAUGGUdTdT | ACCAUGUUGUUUCAAAGUGdTdT | 1141-1159 |
| 3717 | 3718 | AD-59431 | AAGUGAUGAGUGAAAGAGAdTdT | UCUCUUUCACUCAUCACUUdTdT | 2193-2211 |
| 3719 | 3720 | AD-59423 | AUCUGCUAGUCACAUGGAAdTdT | UUCCAUGUGACUAGCAGAUdTdT | 2103-2121 |
| 3721 | 3722 | AD-59517 | UGGGGCAGGUGGUACUAGAdTdT | UCUAGUACCACCUGCCCCAdTdT | 1162-1180 |
| 3723 | 3724 | AD-59578 | GCAGAUGACUAUUCAGACUdTdT | AGUCUGAAUAGUCAUCUGCdTdT | 1031-1049 |

TABLE 18-continued

Human ALAS1 Modified Single Strands and Duplex Sequences

| SEQ ID NO: (sense) | SEQ ID NO: (anti-sense) | Duplex Name | Sense Sequence (5'-3') | Antisense Sequence (5'-3') | Target sites of antisense sequence on NM_000688.4 |
|---|---|---|---|---|---|
| 3725 | 3726 | AD-59495 | GCCUCAUUCCUCAGCUGAGdTdT | CUCAGCUGAGGAAUGAGGCdTdT | 2143-2161 |
| 3727 | 3728 | AD-59432 | GUAUGAUCGUUUCUUUGAGdTdT | CUCAAAGAAACGAUCAUACdTdT | 931-949 |
| 3729 | 3730 | AD-59382 | UAUCCAGAUGGUCUUCAGAdTdT | UCUGAAGACCAUCUGGAUAdTdT | 2302-2320 |
| 3731 | 3732 | AD-59472 | UAGUGUGAAAACCGAUGGAdTdT | UCCAUCGGUUUUCACACUAdTdT | 799-817 |
| 3733 | 3734 | AD-59459 | UCCCCAUGGCAGAUGACUAdTdT | UAGUCAUCUGCCAUGGGGAdTdT | 1023-1041 |
| 3735 | 3736 | AD-59413 | CCACUGCAGCAGUACACUAdTdT | UAGUGUACUGCUGCAGUGGdTdT | 483-501 |
| 3737 | 3738 | AD-59478 | CUGUGAACCGGCGAGCACAdTdT | UGUGCUCGCCGGUUCACAGdTdT | 999-1017 |
| 3739 | 3740 | AD-59376 | GGUCCUAUGCUGCUGGCUUdTdT | AAGCCAGCAGCAUAGGACCdTdT | 1731-1749 |
| 3741 | 3742 | AD-59556 | AGCCUUUGGUUGUGUUGGAdTdT | UCCAACACAACCAAAGGCUdTdT | 1672-1690 |
| 3743 | 3744 | AD-59399 | AAUUCCAUGUGGACUUAGAdTdT | UCUAAGUCCACAUGGAAUUdTdT | 1200-1218 |
| 3745 | 3746 | AD-59474 | CCAGGGCACUGCAAGCAAAdTdT | UUUGCUUGCAGUGCCCUGGdTdT | 640-658 |
| 3747 | 3748 | AD-53542 | cuuuucAGuAuGAucGuuudTsdT | AAACGAUcAuACUGAAAAGdTsdT | 924-942 |
| 3749 | 3750 | AD-59480 | GAAUCAGAGAGGCAGCAGUdTdT | ACUGCUGCCUCUCUGAUUCdTdT | 682-700 |
| 3751 | 3752 | AD-59549 | GCAAAGAUCUGACCCCUCAdTdT | UGAGGGGUCAGAUCUUUGCdTdT | 1441-1459 |
| 3753 | 3754 | AD-59515 | GGAGAAGAGCUCCUACGGAdTdT | UCCGUAGGAGCUCUUCUCCdTdT | 2033-2051 |
| 3755 | 3756 | AD-59427 | CCAUGAGUUUGGAGCAAUCdTdT | GAUUGCUCCAAACUCAUGGdTdT | 1540-1558 |
| 3757 | 3758 | AD-59390 | CUUUGAGAAAAAAAUUGAUdTdT | AUCAAUUUUUUCUCAAAGdTdT | 943-961 |
| 3759 | 3760 | AD-59511 | UGAGCAGACAUAACAUCUAdTdT | UAGAUGUUAUGUCUGCUCAdTdT | 1980-1998 |
| 3761 | 3762 | AD-59532 | CGUGCAAGCAAUCAAUUACdTdT | GUAAUUGAUUGCUUGCACGdTdT | 1999-2017 |
| 3763 | 3764 | AD-59562 | AAAGCAAAGACCAGAAAGAdTdT | UCUUUCUGGUCUUUGCUUUdTdT | 862-880 |
| 3765 | 3766 | AD-59513 | GGAUGUGCAGGAAAUGAAUdTdT | AUUCAUUUCCUGCACAUCCdTdT | 733-751 |
| 3767 | 3768 | AD-59362 | CAGCAUACUUCCUGAACAUdTdT | AUGUUCAGGAAGUAUGCUGdTdT | 321-339 |
| 3769 | 3770 | AD-53541 | GcAGcAcAGAuGAAucAGAdTsdT | UCUGAUUcAUCUGUGCUGCdTsdT | 671-689 |
| 3771 | 3772 | AD-59490 | UCUGUUGUUCUAUGCCCAAdTdT | UUGGGCAUAGAACAACAGAdTdT | 412-430 |
| 3773 | 3774 | AD-59422 | UGAGACAGAUGCUAAUGGAdTdT | UCCAUUAGCAUCUGUCUCAdTdT | 1869-1887 |
| 3775 | 3776 | AD-59467 | GCCAAUGACUCAACCCUCUdTdT | AGAGGGUUGAGUCAUUGGCdTdT | 1280-1298 |
| 3777 | 3778 | AD-59579 | GAGUGCAACUUCUGCAGGAdTdT | UCCUGCAGAAGUUGCACUCdTdT | 2159-2177 |
| 3779 | 3780 | AD-59426 | GUGAAAGAGAGAAGUCCUAdTdT | UAGGACUUCUCUCUUUCACdTdT | 2202-2220 |
| 3781 | 3782 | AD-59363 | UAACUUGCCAAAAUCUGUUdTdT | AACAGAUUUUGGCAAGUUAdTdT | 901-919 |
| 3783 | 3784 | AD-59436 | AAGCCAGUCUUGAGCUUCAdTdT | UGAAGCUCAAGACUGGCUUdTdT | 711-729 |
| 3785 | 3786 | AD-53536 | cAcuuuucAGuAuGAucGudTsdT | ACGAUcAuACUGAAAAGUGdTsdT | 922-940 |
| 3787 | 3788 | AD-59491 | GCAGCAGUGUCUUCUGCAAdTdT | UUGCAGAAGACACUGCUGCdTdT | 693-711 |
| 3789 | 3790 | AD-59500 | UCCUGAACAUGGAGAGUGUdTdT | ACACUCUCCAUGUUCAGGAdTdT | 330-348 |
| 3791 | 3792 | AD-59394 | AUUUCUGGAACACUUGGCAdTdT | UGCCAAGUGUUCCAGAAAUdTdT | 1652-1670 |
| 3793 | 3794 | AD-59441 | CAGUACACUACCAACAGAUdTdT | AUCUGUUGGUAGUGUACUGdTdT | 492-510 |
| 3795 | 3796 | AD-59365 | GCAUGACCUCAAUUAUUUCdTdT | GAAAUAAUUGAGGUCAUGCdTdT | 2261-2279 |

TABLE 18-continued

Human ALAS1 Modified Single Strands and Duplex Sequences

| SEQ ID NO: (sense) | SEQ ID NO: (anti-sense) | Duplex Name | Sense Sequence (5'-3') | Antisense Sequence (5'-3') | Target sites of antisense sequence on NM_000688.4 |
|---|---|---|---|---|---|
| 3797 | 3798 | AD-59411 | AGAACUGCUGCAAAGAUCUdTdT | AGAUCUUUGCAGCAGUUCUdTdT | 1432-1450 |
| 3799 | 3800 | AD-59544 | CACCCCAGAUGAUGAACUAdTdT | UAGUUCAUCAUCUGGGGUGdTdT | 2073-2091 |
| 3801 | 3802 | AD-59428 | GAUCCAAGGGAUUCGAAACdTdT | GUUUCGAAUCCCUUGGAUCdTdT | 1363-1381 |
| 3803 | 3804 | AD-59471 | CUCAUCACCAAAAAGCAAGdTdT | CUUGCUUUUUGGUGAUGAGdTdT | 1052-1070 |
| 3805 | 3806 | AD-59518 | ACAACAUGGUGCUGGGGCAdTdT | UGCCCCAGCACCAUGUUGUdTdT | 1150-1168 |
| 3807 | 3808 | AD-53547 | GAucGuuucuuuGAGAAAAdTsdT | UUUUCUcAAAGAAACGAUCdTsdT | 935-953 |
| 3809 | 3810 | AD-59573 | CAGCACGAGUUCUCUGAUUdTdT | AAUCAGAGAACUCGUGCUGdTdT | 1702-1720 |
| 3811 | 3812 | AD-59473 | AAUGAUGUCAGCCACCUCAdTdT | UGAGGUGGCUGACAUCAUUdTdT | 1412-1430 |
| 3813 | 3814 | AD-59412 | AGUUAUGGACACUUUGAAAdTdT | UUUCAAAGUGUCCAUAACUdTdT | 1132-1150 |
| 3815 | 3816 | AD-59522 | GAUGAUGAACUACUUCCUUdTdT | AAGGAAGUAGUUCAUCAUCdTdT | 2080-2098 |
| 3817 | 3818 | AD-59502 | GCAGGAAAUGAAUGCCGUGdTdT | CACGGCAUUCAUUUCCUGCdTdT | 739-757 |
| 3819 | 3820 | AD-59499 | UCUUCAAGAUAACUUGCCAdTdT | UGGCAAGUUAUCUUGAAGAdTdT | 892-910 |
| 3821 | 3822 | AD-59520 | CGAUGGAGGGGAUCCCAGUdTdT | ACUGGGAUCCCCUCCAUCGdTdT | 811-829 |
| 3823 | 3824 | AD-59581 | CCAAAAAGCAAGUGUCAGUdTdT | ACUGACACUUGCUUUUUGGdTdT | 1059-1077 |
| 3825 | 3826 | AD-59461 | GAUUGGGGAUCGGGAUGGAdTdT | UCCAUCCCGAUCCCCAAUCdTdT | 1612-1630 |
| 3827 | 3828 | AD-59370 | CCCUGGAGUCUGUGCGGAUdTdT | AUCCGCACAGACUCCAGGGdTdT | 1791-1809 |
| 3829 | 3830 | AD-53540 | GuuGucuuuAuAuGuGAAudTsdT | AUUcAcAuAuAAAGAcAACdTsdT | 2321-2339 |
| 3831 | 3832 | AD-59574 | CGGGCAUUGUCCACUGCAGdTdT | CUGCAGUGGACAAUGCCCGdTdT | 473-491 |
| 3833 | 3834 | AD-59375 | UAUUCAGACUCCCUCAUCAdTdT | UGAUGAGGGAGUCUGAAUAdTdT | 1040-1058 |
| 3835 | 3836 | AD-59387 | CACUGCAUUUUGAAGUGAUdTdT | AUCACUUCAAAAUGCAGUGdTdT | 2181-2199 |
| 3837 | 3838 | AD-59397 | CCAGAAAGAGUGUCUCAUCdTdT | GAUGAGACACUCUUUCUGGdTdT | 872-890 |
| 3839 | 3840 | AD-59396 | AGGCGGAGGGAUUGGGGAUdTdT | AUCCCCAAUCCCUCCGCCUdTdT | 1603-1621 |
| 3841 | 3842 | AD-59393 | AGACCUCCAUGGGAAAGAUdTdT | AUCUUUCCCAUGGAGGUCUdTdT | 1231-1249 |
| 3843 | 3844 | AD-59483 | GCAGGAGGCCACUGCAUUUdTdT | AAAUGCAGUGGCCUCCUGCdTdT | 2172-2190 |
| 3845 | 3846 | AD-59430 | AUCUGUUCCACUUUUCAGdTdT | CUGAAAAGUGGAAACAGAUdTdT | 913-931 |
| 3847 | 3848 | AD-59463 | AGAAGUCCUAUUUCUCAdTdT | UGAGAAAUAGGACUUCUCdTdT | 2209-2227 |
| 3849 | 3850 | AD-53534 | GucuucAGAGuuGucuuuAdTsdT | uAAAGAcAACUCUGAAGACdTsdT | 2312-2330 |
| 3851 | 3852 | AD-59514 | GGCUGGAACUGAAGCCUCAdTdT | UGAGGCUUCAGUUCCAGCCdTdT | 2130-2148 |
| 3853 | 3854 | AD-59575 | GCCAUUAUCAUAUCCAGAUdTdT | AUCUGGAUAUGAUAAUGGCdTdT | 2292-2310 |
| 3855 | 3856 | AD-59364 | AGCAGGCCCCAGUGUGGUUdTdT | AACCACACUGGGGCCUGCUdTdT | 781-799 |
| 3857 | 3858 | AD-59402 | UCAGCUGAGUGCAACUUCUdTdT | AGAAGUUGCACUCAGCUGAdTdT | 2153-2171 |
| 3859 | 3860 | AD-59479 | GAGCACACAUCUUCCCCAUdTdT | AUGGGGAAGAUGUGUGCUCdTdT | 1011-1029 |
| 3861 | 3862 | AD-59481 | ACUUCCAGGACAUCAUGCAdTdT | UGCAUGAUGUCCUGGAAGUdTdT | 843-861 |
| 3863 | 3864 | AD-59530 | CCUAUCGAGUUUUAAAACdTdT | GUUUUAAAACUCGAUAGGdTdT | 981-999 |
| 3865 | 3866 | AD-59582 | CUUCCUUGAGAAUCUGCUAdTdT | UAGCAGAUUCUCAAGGAAGdTdT | 2092-2110 |
| 3867 | 3868 | AD-59506 | ACCAACAGAUCAAAGAAACdTdT | GUUUCUUUGAUCUGUUGGUdTdT | 501-519 |

TABLE 18-continued

Human ALAS1 Modified Single Strands and Duplex Sequences

| SEQ ID NO: (sense) | SEQ ID NO: (anti-sense) | Duplex Name | Sense Sequence (5'-3') | Antisense Sequence (5'-3') | Target sites of antisense sequence on NM_000688.4 |
|---|---|---|---|---|---|
| 3869 | 3870 | AD-59567 | UAACCCCAGGCCAUUAUCAdTdT | UGAUAAUGGCCUGGGGUUAdTdT | 2283-2301 |
| 3871 | 3872 | AD-59485 | CCAUGCCUCCAUGAUCCAAdTdT | UUGGAUCAUGGAGGCAUGGdTdT | 1351-1369 |
| 3873 | 3874 | AD-59525 | UGAUGAACUAAUGAGCAGAdTdT | UCUGCUCAUUAGUUCAUCAdTdT | 1969-1987 |
| 3875 | 3876 | AD-59566 | CCUGAAGAGCGCUGAGGGAdTdT | UCCCUCAGCGCUCUUCAGGdTdT | 1810-1828 |
| 3877 | 3878 | AD-59580 | AACACUUGGCAAAGCCUUUdTdT | AAAGGCUUUGCCAAGUGUUdTdT | 1660-1678 |
| 3879 | 3880 | AD-59512 | UCUGCAGAAAGCAGGCAAAdTdT | UUUGCCUGCUUUCUGCAGAdTdT | 391-409 |
| 3881 | 3882 | AD-59475 | CCGGCCUCCCUGUUGUCCAdTdT | UGGACAACAGGGAGGCCGGdTdT | 1890-1908 |
| 3883 | 3884 | AD-59438 | CAUCAUCCCUGUGCGGGUUdTdT | AACCCGCACAGGGAUGAUGdTdT | 1921-1939 |
| 3885 | 3886 | AD-59442 | UGUGCGGGUUGCAGAUGCUdTdT | AGCAUCUGCAACCCGCACAdTdT | 1930-1948 |
| 3887 | 3888 | AD-59516 | GGAAAGAGGUUGCUGAAACdTdT | GUUUCAGCAACCUCUUUCCdTdT | 759-777 |
| 3889 | 3890 | AD-59429 | AGGUCCACGCAGUGGGGCUdTdT | AGCCCCACUGCGUGGACCUdTdT | 1572-1590 |
| 3891 | 3892 | AD-59510 | UGCCGUGAGGAAAGAGGUUdTdT | AACCUCUUUCCUCACGGCAdTdT | 751-769 |
| 3893 | 3894 | AD-59457 | GCUAAUGGAUGCCGGCCUCdTdT | GAGGCCGGCAUCCAUUAGCdTdT | 1879-1897 |
| 3895 | 3896 | AD-59434 | GAAGCAAGUGGGGCUGGAAdTdT | UUCCAGCCCCACUUGCUUCdTdT | 2119-2137 |
| 3897 | 3898 | AD-59454 | CAUCUUCCGCCACAAUGAUdTdT | AUCAUUGUGGCGGAAGAUGdTdT | 1399-1417 |
| 3899 | 3900 | AD-59468 | AUUUCUCAGGCUUGAGCAAdTdT | UUGCUCAAGCCUGAGAAAUdTdT | 2220-2238 |
| 3901 | 3902 | AD-59565 | CCCGAGUCCCCCAGGCCUUdTdT | AAGGCCUGGGGGACUCGGGdTdT | 372-390 |
| 3903 | 3904 | AD-59416 | CAAGCAAAUGCCCUUUCCUdTdT | AGGAAAGGGCAUUUGCUUGdTdT | 651-669 |
| 3905 | 3906 | AD-59420 | CCCCUCAGUCCCCAAGAUUdTdT | AAUCUUGGGGACUGAGGGGdTdT | 1453-1471 |
| 3907 | 3908 | AD-59552 | CUACGGUGCCCCGGGGAGAdTdT | UCUCCCCGGGGCACCGUAGdTdT | 2019-2037 |
| 3909 | 3910 | AD-59558 | AAAACUGCCCCAAGAUGAUdTdT | AUCAUCUUGGGGCAGUUUUdTdT | 429-447 |
| 3911 | 3912 | AD-59404 | ACAAAACUGCUAAGGCCAAdTdT | UUGGCCUUAGCAGUUUUGUdTdT | 540-558 |
| 3913 | 3914 | AD-59455 | GAUUCUGGGAACCAUGCCUdTdT | AGGCAUGGUUCCCAGAAUCdTdT | 1340-1358 |
| 3915 | 3916 | AD-59496 | CCAGAUGGCACACAGCUUCdTdT | GAAGCUGUGUGCCAUCUGGdTdT | 593-611 |
| 3917 | 3918 | AD-59446 | AGGGAUUCGAAACAGCCGAdTdT | UCGGCUGUUUCGAAUCCCUdTdT | 1369-1387 |
| 3919 | 3920 | AD-59435 | CUCUGCAGUCCUCAGCGCAdTdT | UGCGCUGAGGACUGCAGAGdTdT | 109-127 |
| 3921 | 3922 | AD-59419 | CCGCCGCCUCUGCAGUCCUdTdT | AGGACUGCAGAGGCGGCGGdTdT | 102-120 |
| 3923 | 3924 | AD-59533 | CUGGCUGGAGCCCUGGAGUdTdT | ACUCCAGGGCUCCAGCCAGdTdT | 1781-1799 |
| 3925 | 3926 | AD-59366 | GACAUCAUGCAAAAGCAAAdTdT | UUUGCUUUUGCAUGAUGUCdTdT | 851-869 |
| 3927 | 3928 | AD-59521 | GCUUGAGCAAGUUGGUAUCdTdT | GAUACCAACUUGCUCAAGCdTdT | 2229-2247 |
| 3929 | 3930 | AD-59563 | CAGGCUGUGAGAUUUACUCdTdT | GAGUAAAUCUCACAGCCUGdTdT | 1320-1338 |
| 3931 | 3932 | AD-59534 | AGAGCUGUGUGAUGUGGCCdTdT | GGCCACAUCACACAGCUCUdTdT | 1522-1540 |
| 3933 | 3934 | AD-59407 | GGAGCUGGCAGACCUCCAUdTdT | AUGGAGGUCUGCCAGCUCCdTdT | 1222-1240 |
| 3935 | 3936 | AD-59445 | AUCCCAGUGGACUGCUGAAdTdT | UUCAGCAGUCCACUGGGAUdTdT | 822-840 |
| 3937 | 3938 | AD-59546 | GUCAAACUCAUGAGACAGAdTdT | UCUGUCUCAUGAGUUUGACdTdT | 1859-1877 |
| 3939 | 3940 | AD-59456 | CUUUCCUGGCAGCACAGAUdTdT | AUCUGUGCUGCCAGGAAAGdTdT | 663-681 |

TABLE 18-continued

Human ALAS1 Modified Single Strands and Duplex Sequences

| SEQ ID NO: (sense) | SEQ ID NO: (anti-sense) | Duplex Name | Sense Sequence (5'-3') | Antisense Sequence (5'-3') | Target sites of antisense sequence on NM_000688.4 |
|---|---|---|---|---|---|
| 3941 | 3942 | AD-59503 | CCCUCCGGCCAGUGAGAAAdTdT | UUUCUCACUGGCCGGAGGGdTdT | 520-538 |
| 3943 | 3944 | AD-59536 | CUACCUAGGAAUGAGUCGCdTdT | GCGACUCAUUCCUAGGUAGdTdT | 1093-1111 |
| 3945 | 3946 | AD-59385 | CCCAAGAUUGUGGCAUUUGdTdT | CAAAUGCCACAAUCUUGGGdTdT | 1463-1481 |
| 3947 | 3948 | AD-59367 | GAGCAAUCACCUUCGUGGAdTdT | UCCACGAAGGUGAUUGCUCdTdT | 1551-1569 |
| 3949 | 3950 | AD-59458 | UGCCCAUUCUUAUCCCGAGdTdT | CUCGGGAUAAGAAUGGGCAdTdT | 359-377 |
| 3951 | 3952 | AD-59381 | AAGGCCAAGGUCCAACAGAdTdT | UCUGUUGGACCUUGGCCUUdTdT | 551-569 |
| 3953 | 3954 | AD-59538 | CACACAGCUUCCGUCUGGAdTdT | UCCAGACGGAAGCUGUGUGdTdT | 601-619 |
| 3955 | 3956 | AD-59421 | UUAUGGGGCUCGAGGCGGAdTdT | UCCGCCUCGAGCCCCAUAAdTdT | 1591-1609 |
| 3957 | 3958 | AD-59388 | UGUCUUCUGCAAAGCCAGUdTdT | ACUGGCUUUGCAGAAGACAdTdT | 700-718 |
| 3959 | 3960 | AD-59444 | AGGCCUGAGCAUGACCUCAdTdT | UGAGGUCAUGCUCAGGCCUdTdT | 2253-2271 |
| 3961 | 3962 | AD-59528 | AUGUGAAUUAAGUUAUAUUdTdT | AAUAUAACUUAAUUCACAUdTdT | 2332-2350 |
| 3963 | 3964 | AD-59498 | ACUGCUGAAGAACUUCCAGdTdT | CUGGAAGUUCUUCAGCAGUdTdT | 832-850 |
| 3965 | 3966 | AD-59497 | UGAGAAAGACAAAACUGCUdTdT | AGCAGUUUUGUCUUUCUCAdTdT | 532-550 |
| 3967 | 3968 | AD-59384 | UCAGCCACCUCAGAGAACUdTdT | AGUUCUCUGAGGUGGCUGAdTdT | 1419-1437 |
| 3969 | 3970 | AD-59452 | GGCAACGAGCGUUUCGUUUdTdT | AAACGAAACGCUCGUUGCCdTdT | 51-69 |
| 3971 | 3972 | AD-59379 | CCUGAUGGAUCCCAGCAGAdTdT | UCUGCUGGGAUCCAUCAGGdTdT | 572-590 |
| 3973 | 3974 | AD-59529 | UGUGCCCACUGGAAGAGCUdTdT | AGCUCUUCCAGUGGGCACAdTdT | 1509-1527 |
| 3975 | 3976 | AD-59389 | CCACAGGAGCCAGCAUACUdTdT | AGUAUGCUGGCUCCUGUGGdTdT | 311-329 |
| 3977 | 3978 | AD-59585 | GUGGUACUAGAAAUAUUUCdTdT | GAAAUAUUUCUAGUACCACdTdT | 1170-1188 |
| 3979 | 3980 | AD-59570 | UUCGCCGCUGCCCAUUCUUdTdT | AAGAAUGGGCAGCGGCGAAdTdT | 351-369 |
| 3981 | 3982 | AD-59415 | CCGCCAGCACCAGCGCAACdTdT | GUUGCGCUGGUGCUGGCGGdTdT | 1840-1858 |
| 3983 | 3984 | AD-59505 | CGCUGAGGGACGGGUGCUUdTdT | AAGCACCCGUCCCUCAGCGdTdT | 1819-1837 |
| 3985 | 3986 | AD-59557 | UGGACUUCUCGACUUGAGUdTdT | ACUCAAGUCGAGAAGUCCAdTdT | 69-87 |
| 3987 | 3988 | AD-59548 | AAAGAAACCCCUCCGGCCAdTdT | UGGCCGGAGGGGUUUCUUUdTdT | 512-530 |
| 3989 | 3990 | AD-59487 | UUGACACCGUACGGUCCUAdTdT | UAGGACCGUACGGUGUCAAdTdT | 1719-1737 |
| 3991 | 3992 | AD-59550 | CCCUCUUCACCCUGGCUAAdTdT | UUAGCCAGGGUGAAGAGGGdTdT | 1293-1311 |
| 3993 | 3994 | AD-59572 | CCCCCAGGCCUUUCUGCAGdTdT | CUGCAGAAAGGCCUGGGGGdTdT | 379-397 |
| 3995 | 3996 | AD-59554 | AUGCCCAAAACUGCCCCAAdTdT | UUGGGGCAGUUUUGGGCAUdTdT | 423-441 |
| 3997 | 3998 | AD-59437 | CUUGAGUGCCCGCCUCCUUdTdT | AAGGAGGCGGGCACUCAAGdTdT | 81-99 |
| 3999 | 4000 | AD-59584 | GGGUACAUCGCCAGCACGAdTdT | UCGUGCUGGCGAUGUACCCdTdT | 1691-1709 |
| 4001 | 4002 | AD-59373 | GUGUGGGGCAGUUAUGGACdTdT | GUCCAUAACUGCCCCACACdTdT | 1123-1141 |
| 4003 | 4004 | AD-59545 | ACAUAGUCCUGGAAAUAAAdTdT | UUUAUUUCCAGGACUAUGUdTdT | 2372-2390 |
| 4005 | 4006 | AD-59547 | AUCCCAGCAGAGUCCAGAUdTdT | AUCUGGACUCUGCUGGGAUdTdT | 580-598 |
| 4007 | 4008 | AD-59470 | CUAGAUUCUUCCACAGGAdTdT | UCCUGUGGAAGAAUCUAGdTdT | 300-318 |
| 4009 | 4010 | AD-59417 | UUGUUUUCCUCGUGCUUUGdTdT | CAAAGCACGAGGAAAACAAdTdT | 1259-1277 |
| 4011 | 4012 | AD-59535 | CCUCCUUCGCCGCCGCCUCdTdT | GAGGCGGCGGCGAAGGAGGdTdT | 93-111 |

TABLE 18-continued

Human ALAS1 Modified Single Strands and Duplex Sequences

| SEQ ID NO: (sense) | SEQ ID NO: (anti-sense) | Duplex Name | Sense Sequence (5'-3') | Antisense Sequence (5'-3') | Target sites of antisense sequence on NM_000688.4 |
|---|---|---|---|---|---|
| 4013 | 4014 | AD-59507 | UGAGGCUGCUCCCGGACAAdTdT | UUGUCCGGGAGCAGCCUCAdTdT | 31-49 |
| 4015 | 4016 | AD-59519 | CCAACAGACUCCUGAUGGAdTdT | UCCAUCAGGAGUCUGUUGGdTdT | 562-580 |
| 4017 | 4018 | AD-59391 | UCACAUGGAAGCAAGUGGGdTdT | CCCACUUGCUUCCAUGUGAdTdT | 2112-2130 |
| 4019 | 4020 | AD-59537 | CAUUCAAUGGAUGGGGCGGdTdT | CCGCCCCAUCCAUUGAAUGdTdT | 1490-1508 |
| 4021 | 4022 | AD-59450 | AGGAAUGAGUCGCCACCCAdTdT | UGGGUGGCGACUCAUUCCUdTdT | 1099-1117 |
| 4023 | 4024 | AD-59449 | UGGACUUAGAGCGGGAGCUdTdT | AGCUCCCGCUCUAAGUCCAdTdT | 1209-1227 |
| 4025 | 4026 | AD-59418 | CUAAAAACACAGAAGUCUGdTdT | CAGACUUCUGUGUUUUUAGdTdT | 1950-1968 |
| 4027 | 4028 | AD-59561 | CCCUCACCACACACCCCAGdTdT | CUGGGGUGUGUGGUGAGGGdTdT | 2062-2080 |
| 4029 | 4030 | AD-59460 | AAUCCUUGCUUCAGGGACUdTdT | AGUCCCUGAAGCAAGGAUUdTdT | 171-189 |
| 4031 | 4032 | AD-59409 | UUGUGGCAUUUGAAACUGUdTdT | ACAGUUUCAAAUGCCACAAdTdT | 1470-1488 |
| 4033 | 4034 | AD-59476 | UCAAUUACCCUACGGUGCCdTdT | GGCACCGUAGGGUAAUUGAdTdT | 2010-2028 |
| 4035 | 4036 | AD-59406 | CAAGCCAGCCCCUCGGGCAdTdT | UGCCCGAGGGGCUGGCUUGdTdT | 460-478 |
| 4037 | 4038 | AD-59569 | GAGUCUUCCCUGCCUGGAUdTdT | AUCCAGGCAGGGAAGACUCdTdT | 259-277 |
| 4039 | 4040 | AD-59451 | UGGAGAGUGUUGUUCGCCGdTdT | CGGCGAACAACACUCUCCAdTdT | 339-357 |
| 4041 | 4042 | AD-59553 | ACCCCUUGCCUGCCACAAGdTdT | CUUGUGGCAGGCAAGGGGUdTdT | 621-639 |
| 4043 | 4044 | AD-59372 | CUGGAUGGAUGAGUGGCUUdTdT | AAGCCACUCAUCCAUCCAGdTdT | 272-290 |
| 4045 | 4046 | AD-59377 | CAAGAUGAUGGAAGUUGGGdTdT | CCCAACUUCCAUCAUCUUGdTdT | 439-457 |
| 4047 | 4048 | AD-59531 | UUUCGUUUGGACUUCUCGAdTdT | UCGAGAAGUCCAAACGAAAdTdT | 62-80 |
| 4049 | 4050 | AD-59560 | UCAUCUUCACCACCUCUCUdTdT | AGAGAGGUGGUGAAGAUGAdTdT | 1749-1767 |
| 4051 | 4052 | AD-59489 | UGCCCAGUUCUUCCCGCUGdTdT | CAGCGGGAAGAACUGGGCAdTdT | 132-150 |
| 4053 | 4054 | AD-59540 | AAAAAUGGACAUCAUUUCUdTdT | AGAAAUGAUGUCCAUUUUUdTdT | 1639-1657 |
| 4055 | 4056 | AD-59378 | CUUGAGCUUCAGGAGGAUGdTdT | CAUCCUCCUGAAGCUCAAGdTdT | 719-737 |
| 4057 | 4058 | AD-59403 | CCUCUCUGCCACCCAUGCUdTdT | AGCAUGGGUGGCAGAGAGGdTdT | 1761-1779 |
| 4059 | 4060 | AD-59493 | AAAGUCAGGAUCCCUAAGAdTdT | UCUUAGGGAUCCUGACUUUdTdT | 242-260 |
| 4061 | 4062 | AD-59374 | CGACCACGGAGGAAUCCUUdTdT | AAGGAUUCCUCCGUGGUCGdTdT | 159-177 |
| 4063 | 4064 | AD-59380 | UUCCGUCUGGACACCCCUUdTdT | AAGGGGUGUCCAGACGGAAdTdT | 609-627 |
| 4065 | 4066 | AD-59576 | CCACCCAUGCUGCUGGCUGdTdT | CAGCCAGCAGCAUGGGUGGdTdT | 1769-1787 |
| 4067 | 4068 | AD-59425 | UGAGAAAAAGAAUGACCACdTdT | GUGGUCAUUCUUUUUCUCAdTdT | 961-979 |
| 4069 | 4070 | AD-59509 | UAAGAUGAUGCCAGGCUGUdTdT | ACAGCCUGGCAUCAUCUUAdTdT | 1309-1327 |
| 4071 | 4072 | AD-59488 | AGUUAUAUUAAAUUUUAAdTdT | AUUAAAAUUUAAUAUAACUdTdT | 2342-2360 |
| 4073 | 4074 | AD-59486 | UCUUCCCGCUGUGGGGACAdTdT | UGUCCCCACAGCGGGAAGAdTdT | 140-158 |
| 4075 | 4076 | AD-59465 | UGCCACAAGCCAGGGCACUdTdT | AGUGCCCGGCUUGUGGCAdTdT | 631-649 |
| 4077 | 4078 | AD-59484 | AGCGCAGUUAUGCCCAGUUdTdT | AACUGGGCAUAACUGCGCUdTdT | 122-140 |
| 4079 | 4080 | AD-59368 | GGACCAGGAGAAAGUCAGGdTdT | CCUGACUUUCUCCUGGUCCdTdT | 232-250 |
| 4081 | 4082 | AD-59464 | UGUCCACUGCCCCAGCCACdTdT | GUGGCUGGGGCAGUGGACAdTdT | 1903-1921 |
| 4083 | 4084 | AD-59386 | AUCGCGGCCUGAGGCUGCUdTdT | AGCAGCCUCAGGCCGCGAUdTdT | 22-40 |

TABLE 18-continued

Human ALAS1 Modified Single Strands and Duplex Sequences

| SEQ ID NO: (sense) | SEQ ID NO: (anti-sense) | Duplex Name | Sense Sequence (5'-3') | Antisense Sequence (5'-3') | Target sites of antisense sequence on NM_000688.4 |
|---|---|---|---|---|---|
| 4085 | 4086 | AD-59439 | GGGGAUGUGGGGACCAGGAdTdT | UCCUGGUCCCCACAUCCCCdTdT | 222-240 |
| 4087 | 4088 | AD-59440 | CUGGAAAUAAAUUCUUGCUdTdT | AGCAAGAAUUUAUUUCCAGdTdT | 2380-2398 |
| 4089 | 4090 | AD-59542 | UUGAAACUGUCCAUUCAAUdTdT | AUUGAAUGGACAGUUUCAAdTdT | 1479-1497 |
| 4091 | 4092 | AD-59559 | GUGGGGACACGACCACGGAdTdT | UCCGUGGUCGUGUCCCCACdTdT | 150-168 |
| 4093 | 4094 | AD-59586 | CGCAGUGGGGCUUUAUGGGdTdT | CCCAUAAAGCCCCACUGCGdTdT | 1579-1597 |
| 4095 | 4096 | AD-59408 | UUGUCUUUAUAUGUGAAUUdTdT | AAUUCACAUAUAAAGACAAdTdT | 2322-2340 |
| 4097 | 4098 | AD-59568 | UCACCCUGGCUAAGAUGAUdTdT | AUCAUCUUAGCCAGGGUGAdTdT | 1299-1317 |
| 4099 | 4100 | AD-59398 | GUAUCUGCUCAGGCCUGAdTdT | CUCAGGCCUGAGCAGAUACdTdT | 2243-2261 |
| 4101 | 4102 | AD-59508 | AUGAGUGGCUUCUUCUCCAdTdT | UGGAGAAGAAGCCACUCAUdTdT | 280-298 |
| 4103 | 4104 | AD-59523 | GAAGUUGGGGCCAAGCCAGdTdT | CUGGCUUGGCCCCAACUUCdTdT | 449-467 |
| 4105 | 4106 | AD-59410 | UCAGGGACUCGGGACCCUGdTdT | CAGGGUCCCGAGUCCCUGAdTdT | 181-199 |
| 4107 | 4108 | AD-59541 | UCCUACGGAUUGCCCCACdTdT | GUGGGGGCAAUCCGUAGGAdTdT | 2043-2061 |
| 4109 | 4110 | AD-59524 | UUACUCUGAUUCUGGGAACdTdT | GUUCCCAGAAUCAGAGUAAdTdT | 1333-1351 |
| 4111 | 4112 | AD-59501 | AUCCCUAAGAGUCUUCCCUdTdT | AGGGAAGACUCUUAGGGAUdTdT | 251-269 |
| 4113 | 4114 | AD-59383 | UGCCAAAGUACAUCUUCCGdTdT | CGGAAGAUGUACUUUGGCAdTdT | 1389-1407 |
| 4115 | 4116 | AD-59577 | UCCUCGGGUUUAGGGGAUGdTdT | CAUCCCCUAAACCCGAGGAdTdT | 210-228 |
| 4117 | 4118 | AD-59447 | UGCUGAAACCUCAGCAGGCdTdT | GCCUGCUGAGGUUUCAGCAdTdT | 769-787 |
| 4119 | 4120 | AD-59555 | CCACCCACGGGUGUGUGGGdTdT | CCCACACACCCGUGGGUGGdTdT | 1111-1129 |
| 4121 | 4122 | AD-59405 | UGGUGCAGUAAUGACUACCdTdT | GGUAGUCAUUACUGCACCAdTdT | 1079-1097 |
| 4123 | 4124 | AD-59371 | UUCUCCACCUAGAUUCUUUdTdT | AAAGAAUCUAGGUGGAGAAdTdT | 292-310 |
| 4125 | 4126 | AD-59443 | UAAGGCGCCGGCGAUCGCGdTdT | CGCGAUCGCCGGCGCCUUAdTdT | 9-27 |
| 4127 | 4128 | AD-59401 | UGGAACUAGUAAAUUCCAUdTdT | AUGGAAUUUACUAGUUCCAdTdT | 1189-1207 |
| 4129 | 4130 | AD-59494 | GGACCCUGCUGGACCCCUUdTdT | AAGGGGUCCAGCAGGGUCCdTdT | 192-210 |
| 4131 | 4132 | AD-59504 | UCAAUUAUUUCACUUAACCdTdT | GGUUAAGUGAAAUAAUUGAdTdT | 2269-2287 |
| 4133 | 4134 | AD-59369 | CCCGGACAAGGGCAACGAGdTdT | CUCGUUGCCCUUGUCCGGGdTdT | 41-59 |
| 4135 | 4136 | AD-59571 | UUUUAAAACUGUGAACCGGdTdT | CCGGUUCACAGUUUUAAAAdTdT | 991-1009 |
| 4137 | 4138 | AD-59527 | GUGCUUCGCCGCCAGCACCdTdT | GGUGCUGGCGGCGAAGCACdTdT | 1832-1850 |
| 4139 | 4140 | AD-59466 | UGGACCCCUUCCUCGGGUUdTdT | AACCCGAGGAAGGGGUCCAdTdT | 201-219 |
| 4141 | 4142 | AD-59526 | CUGUAUAUUAAGGCGCCGGdTdT | CCGGCGCCUUAAUAUACAGdTdT | 1-19 |
| 4143 | 4144 | AD-59543 | UUGCCCCCACCCCUCACCAdTdT | UGGUGAGGGGUGGGGGCAAdTdT | 2052-2070 |
| 4145 | 4146 | AD-59564 | AUGGGGCGGUGUGCCCACUdTdT | AGUGGGCACACCGCCCCAUdTdT | 1500-1518 |
| 4147 | 4148 | AD-59583 | CUAUAGUAAAAACAUAGUCdTdT | GACUAUGUUUUUACUAUAGdTdT | 2361-2379 |

The in vitro activity of the siRNAs in suppressing ALAS1 mRNA was tested in a single dose screen in Hep3B cells that were transfected using Lipofectamine2000 as a transfection reagent. Single dose experiments were performed at 10 nM duplex concentration and analyzed by branched DNA (bDNA) assay. The results are shown in Table 19 and are expressed as percent remaining mRNA.

TABLE 19

Suppression of ALAS1 mRNA as assessed by bDNA assay

| Duplex | % remaining mRNA | SD |
| --- | --- | --- |
| AD-59453 | 11.2 | 1.5 |
| AD-59395 | 12.7 | 1.1 |
| AD-59477 | 14.5 | 2.0 |
| AD-59492 | 14.8 | 2.1 |
| AD-59361 | 15.1 | 4.9 |
| AD-59462 | 15.4 | 2.6 |
| AD-59433 | 15.8 | 2.7 |
| AD-59424 | 16.0 | 1.7 |
| AD-59414 | 16.1 | 1.3 |
| AD-59539 | 16.2 | 2.6 |
| AD-59400 | 16.2 | 1.8 |
| AD-59551 | 16.3 | 2.3 |
| AD-59482 | 16.6 | 2.1 |
| AD-59448 | 16.6 | 3.7 |
| AD-59392 | 16.9 | 3.5 |
| AD-59469 | 16.9 | 2.2 |
| AD-59431 | 17.0 | 2.0 |
| AD-59423 | 17.1 | 3.8 |
| AD-59517 | 17.2 | 1.5 |
| AD-59578 | 17.3 | 3.1 |
| AD-59495 | 17.7 | 3.7 |
| AD-59432 | 17.7 | 2.8 |
| AD-59382 | 17.9 | 3.2 |
| AD-59472 | 18.6 | 3.5 |
| AD-59459 | 18.7 | 3.8 |
| AD-59413 | 18.8 | 2.4 |
| AD-59478 | 18.9 | 3.0 |
| AD-59376 | 18.9 | 3.2 |
| AD-59556 | 18.9 | 2.4 |
| AD-59399 | 19.0 | 4.1 |
| AD-59474 | 19.4 | 1.6 |
| AD-53542 | 19.4 | 1.7 |
| AD-59480 | 19.6 | 1.6 |
| AD-59549 | 19.7 | 2.1 |
| AD-59515 | 19.8 | 4.4 |
| AD-59427 | 19.9 | 3.2 |
| AD-59390 | 19.9 | 3.4 |
| AD-59511 | 19.9 | 2.2 |
| AD-59532 | 20.0 | 2.4 |
| AD-59562 | 20.2 | 2.6 |
| AD-59513 | 20.3 | 3.9 |
| AD-59362 | 20.6 | 2.5 |
| AD-53541 | 20.6 | 2.2 |
| AD-59490 | 20.7 | 2.3 |
| AD-59422 | 20.8 | 4.5 |
| AD-59467 | 21.2 | 2.3 |
| AD-59579 | 21.2 | 3.3 |
| AD-59426 | 21.7 | 2.3 |
| AD-59363 | 21.7 | 2.7 |
| AD-59436 | 21.7 | 2.7 |
| AD-53536 | 21.9 | 1.5 |
| AD-59491 | 21.9 | 2.6 |
| AD-59500 | 22.2 | 2.8 |
| AD-59394 | 22.3 | 10.1 |
| AD-59441 | 22.3 | 2.6 |
| AD-59365 | 22.4 | 4.2 |
| AD-59411 | 22.5 | 2.9 |
| AD-59544 | 22.5 | 2.1 |
| AD-59428 | 22.7 | 4.7 |
| AD-59471 | 22.9 | 5.0 |
| AD-59518 | 22.9 | 2.3 |
| AD-53547 | 22.9 | 1.5 |
| AD-59573 | 23.0 | 4.2 |
| AD-59473 | 23.2 | 1.8 |
| AD-59412 | 23.4 | 2.5 |
| AD-59522 | 23.4 | 3.3 |
| AD-59502 | 23.6 | 2.7 |
| AD-59499 | 23.6 | 1.6 |
| AD-59520 | 23.8 | 3.8 |
| AD-59581 | 23.9 | 6.0 |
| AD-59461 | 24.3 | 4.2 |
| AD-59370 | 24.3 | 5.6 |
| AD-53540 | 24.4 | 2.1 |
| AD-59574 | 24.5 | 2.0 |
| AD-59375 | 24.6 | 2.3 |
| AD-59387 | 24.8 | 7.2 |
| AD-59397 | 24.9 | 9.6 |
| AD-59396 | 25.0 | 10.2 |
| AD-59393 | 25.3 | 11.6 |
| AD-59483 | 25.4 | 3.8 |
| AD-59430 | 25.5 | 1.8 |
| AD-59463 | 25.6 | 4.8 |
| AD-53534 | 25.9 | 3.1 |
| AD-59514 | 26.2 | 5.7 |
| AD-59575 | 26.2 | 3.2 |
| AD-59364 | 26.2 | 4.5 |
| AD-59402 | 26.3 | 3.1 |
| AD-59479 | 26.3 | 2.5 |
| AD-59481 | 26.4 | 2.2 |
| AD-59530 | 26.4 | 4.4 |
| AD-59582 | 26.6 | 3.9 |
| AD-59506 | 27.0 | 4.1 |
| AD-59567 | 27.3 | 1.1 |
| AD-59485 | 27.7 | 4.7 |
| AD-59525 | 28.3 | 3.1 |
| AD-59566 | 28.5 | 0.6 |
| AD-59580 | 28.7 | 7.1 |
| AD-59512 | 29.5 | 2.5 |
| AD-59475 | 29.6 | 4.2 |
| AD-59438 | 29.6 | 3.3 |
| AD-59442 | 29.9 | 2.8 |
| AD-59516 | 30.4 | 3.8 |
| AD-59429 | 30.8 | 4.3 |
| AD-59510 | 31.3 | 1.9 |
| AD-59457 | 31.4 | 1.2 |
| AD-59434 | 31.6 | 3.5 |
| AD-59454 | 32.0 | 1.9 |
| AD-59468 | 32.2 | 3.2 |
| AD-59565 | 32.4 | 1.5 |
| AD-59416 | 32.7 | 1.7 |
| AD-59420 | 33.2 | 3.1 |
| AD-59552 | 33.2 | 2.2 |
| AD-59558 | 33.8 | 3.8 |
| AD-59404 | 34.0 | 5.4 |
| AD-59455 | 34.8 | 1.3 |
| AD-59496 | 34.9 | 5.2 |
| AD-59446 | 35.5 | 1.7 |
| AD-59435 | 35.9 | 1.2 |
| AD-59419 | 36.0 | 1.4 |
| AD-59533 | 36.7 | 3.7 |
| AD-59366 | 36.7 | 6.0 |
| AD-59521 | 36.9 | 4.3 |
| AD-59563 | 36.9 | 4.1 |
| AD-59534 | 36.9 | 3.3 |
| AD-59407 | 37.1 | 4.7 |
| AD-59445 | 37.2 | 3.2 |
| AD-59546 | 37.9 | 4.9 |
| AD-59456 | 38.3 | 4.0 |
| AD-59503 | 38.8 | 5.0 |
| AD-59536 | 39.8 | 4.2 |
| AD-59385 | 39.9 | 13.7 |
| AD-59367 | 40.0 | 3.6 |
| AD-59458 | 40.0 | 3.4 |
| AD-59381 | 40.3 | 9.9 |
| AD-59538 | 40.8 | 4.9 |
| AD-59421 | 40.9 | 6.4 |
| AD-59388 | 41.0 | 9.1 |
| AD-59444 | 41.1 | 2.7 |
| AD-59528 | 41.9 | 3.3 |
| AD-59498 | 42.2 | 3.3 |

TABLE 19-continued

Suppression of ALAS1 mRNA as assessed by bDNA assay

| Duplex | % remaining mRNA | SD |
|---|---|---|
| AD-59497 | 42.4 | 4.9 |
| AD-59384 | 42.7 | 17.6 |
| AD-59452 | 42.7 | 3.1 |
| AD-59379 | 43.6 | 2.6 |
| AD-59529 | 43.8 | 4.8 |
| AD-59389 | 44.1 | 6.4 |
| AD-59585 | 44.3 | 3.2 |
| AD-59570 | 45.1 | 4.0 |
| AD-59415 | 46.6 | 2.3 |
| AD-59505 | 47.5 | 6.2 |
| AD-59557 | 48.1 | 4.4 |
| AD-59548 | 49.9 | 4.0 |
| AD-59487 | 50.7 | 3.2 |
| AD-59550 | 50.8 | 5.8 |
| AD-59572 | 51.1 | 4.0 |
| AD-59554 | 51.3 | 6.0 |
| AD-59437 | 52.2 | 4.8 |
| AD-59584 | 54.9 | 2.7 |
| AD-59373 | 55.3 | 20.1 |
| AD-59545 | 55.4 | 3.4 |
| AD-59547 | 55.9 | 4.7 |
| AD-59470 | 56.0 | 2.7 |
| AD-59417 | 56.4 | 7.7 |
| AD-59535 | 57.6 | 5.1 |
| AD-59507 | 58.8 | 4.7 |
| AD-59519 | 59.1 | 5.6 |
| AD-59391 | 60.1 | 12.5 |
| AD-59537 | 60.6 | 9.1 |
| AD-59450 | 60.7 | 7.2 |
| AD-59449 | 61.6 | 6.8 |
| AD-59418 | 61.8 | 8.4 |
| AD-59561 | 62.2 | 7.2 |
| AD-59460 | 62.8 | 4.7 |
| AD-59409 | 64.4 | 9.0 |
| AD-59476 | 65.2 | 5.6 |
| AD-59406 | 65.6 | 3.5 |
| AD-59569 | 66.7 | 7.6 |
| AD-59451 | 66.9 | 2.9 |
| AD-59553 | 67.2 | 8.8 |
| AD-59372 | 67.3 | 25.6 |
| AD-59377 | 68.7 | 5.1 |
| AD-59531 | 68.7 | 9.0 |
| AD-59560 | 68.7 | 12.7 |
| AD-59489 | 69.6 | 8.9 |
| AD-59540 | 70.1 | 10.1 |
| AD-59378 | 70.6 | 14.1 |
| AD-59403 | 71.4 | 3.3 |
| AD-59493 | 72.3 | 3.5 |
| AD-59374 | 75.9 | 5.1 |
| AD-59380 | 76.4 | 11.1 |
| AD-59576 | 77.5 | 16.2 |
| AD-59425 | 77.9 | 10.6 |
| AD-59509 | 78.0 | 3.2 |
| AD-59488 | 78.6 | 7.1 |
| AD-59486 | 79.4 | 5.0 |
| AD-59465 | 79.5 | 5.1 |
| AD-59484 | 79.8 | 3.2 |
| AD-59368 | 80.0 | 11.9 |
| AD-59464 | 80.2 | 9.3 |
| AD-59386 | 80.6 | 33.2 |
| AD-59439 | 80.9 | 4.0 |
| AD-59440 | 82.2 | 1.9 |
| AD-59542 | 83.3 | 10.6 |
| AD-59559 | 83.7 | 9.1 |
| AD-59586 | 83.8 | 11.5 |
| AD-59408 | 86.3 | 2.8 |
| AD-59568 | 86.8 | 4.2 |
| AD-59398 | 87.4 | 24.9 |
| AD-59508 | 87.5 | 2.5 |
| AD-59523 | 87.6 | 11.8 |
| AD-59410 | 88.8 | 8.3 |
| AD-59541 | 88.9 | 10.8 |
| AD-59524 | 89.5 | 12.1 |
| AD-59501 | 89.9 | 5.1 |
| AD-59383 | 90.8 | 27.4 |
| AD-59577 | 91.1 | 2.3 |
| AD-59447 | 91.3 | 12.9 |
| AD-59555 | 91.7 | 3.4 |
| AD-59405 | 92.5 | 5.7 |
| AD-59371 | 93.5 | 31.7 |
| AD-59443 | 93.8 | 9.0 |
| AD-59401 | 94.5 | 7.1 |
| AD-59494 | 95.1 | 9.1 |
| AD-59504 | 96.8 | 11.7 |
| AD-59369 | 96.8 | 4.8 |
| AD-59571 | 97.4 | 7.0 |
| AD-59527 | 98.6 | 7.8 |
| AD-59466 | 99.7 | 14.0 |
| AD-59526 | 102.9 | 4.6 |
| AD-59543 | 103.7 | 3.0 |
| AD-59564 | 103.7 | 12.1 |
| AD-59583 | 112.4 | 13.2 |

The two hundred thirty-two duplexes that were tested suppressed ALAS1 mRNA to varying extents in this single dose assay. According to this assay, at least four of the duplexes (AD-59453, AD-59395, AD-59477, and AD-59492) suppressed ALAS1 mRNA by 85% or more, 39 of the duplexes suppressed ALAS1 mRNA by 80% or more, 101 of the duplexes suppressed ALAS1 mRNA by 70% or more, and 152 of the duplexes suppressed ALAS1 mRNA by 50% or more. In contrast, some duplexes did not show appreciable suppression in this assay.

EQUIVALENTS

Those skilled in the art will recognize, or be able to ascertain using no more than routine experimentation, many equivalents to the specific embodiments of the invention described herein. Such equivalents are intended to be encompassed by the following claims.

SEQUENCE LISTING (4150 sequences)

SEQ ID NO: 1 - DNA, 2407 bp, Homo sapiens
ctgtatattaaggcgccggcgatcgcggcctgaggctgctcccggacaagggcaacgagcgtttcgtttggacttctcgacttgagtgcccgcctccttcgccgccgcctctgcagtcctcagcgcagttatgcccagttcttcccgctgtggggacacgaccacggaggaatccttgcttcagggactcgggaccctgctggaccccttcctcgggtttaggggatgtggggaccaggagaaagtcaggatccctaagagtcttccctgcctggatggatgagtggcttcttctccacctagattctttccacaggagccagcatacttcctgaacatggagagtgttgttcgccgctgcccattcttatcccgagtcccccaggcctttctgcagaaagcaggcaaatctctgttgttctatgcccaaaactgccccaagatgatggaagttggggccaagccagcccctcgggcattgtccactgcagcagtacactaccaacagatcaaagaaacccctccggccagtgagaaagacaaaactgctaaggccaaggtccaacagactcctgatggatcccagcagagtccagatggcacacagcttccgtctggacaccccttgcctgccacaagccagggcactgcaagcaaatgccctttcctggcagcacagatgaatcagagaggcagcagtgtcttctgcaaagccagtcttgagcttcaggaggatgtgcaggaaatgaatgccgtgaggaaagaggttgctgaaacctcagcaggccccagtgtggttagtgtgaaaaccgatggaggggatcccagtggactgctgaagaacttccaggacatcatgcaaaagcaaagaccagaaagagtgtctcatcttcttcaagataacttgccaaaatctgtttccacttttcagtatgatcgtttctttgagaaaaaaattgatgagaaaaagaatgaccacacctatcgagtttttaaaactgtgaaccggcgagcacacatcttccccatggcagatgactattcagactccctcatcaccaaaaagcaagtgtcagtctggtgcagtaatgactacctaggaatgagtcgccacccacgggtgtgtggggcagttatggacactttgaaacaacatggtgctggggcaggtggtactagaaatatttctggaactagtaaattccatgtggacttagagcgggagctggcagacctccatgggaaagatgccgcactcttgttttcctcgtgctttgtggccaatgactcaaccctcttcaccctggctaagatgatgccaggctgtgagatttactctgattctgggaaccatgcctccatgatccaagggattcgaaacagccgagtgccaaagtacatcttccgccacaatgatgtcagccacctcagagaactgctgcaaagatctgacccctcagtccccaagattgtggcatttgaaactgtccattcaatggatggggcggtgtgcccactggaagagctgtgtgatgtggcccatgagtttggagcaatcaccttcgtggatgaggtccacgcagtggggctttatggggctcgaggcggagggattggggatcgggatggagtcatgccaaaaatggacatcatttctggaacacttggcaaagcctttggttgtgttggagggtacatcgccagcacgagttctctgattgacaccgtacggtcctatgctgctggcttcatcttcaccacctctctgccacccatgctgctggctggagccctggagtctgtgcggatcctgaagagcgctgagggacgggtgcttcgccgccagcaccagcgcaacgtcaaactcatgagacagatgctaatggatgccggcctccctgttgtccactgccccagccacatcatccctgtgcgggttgcagatgctgctaaaaacacagaagtctgtgatgaactaatgagcagacataacatctacgtgcaagcaatcaattaccctacggtgccccggggagaagagctcctacggattgcccccacccctcaccacacaccccagatgatgaactacttccttgagaatctgctagtcacatggaagcaagtggggctggaactgaagcctcattcctcagctgagtgcaacttctgcaggaggccactgcattttgaagtgatgagtgaaagagagaagtcctatttctcaggcttgagcaagttggtatctgctcaggcctgagcatgacctcaattatttcacttaaccccaggccattatcatatccagatggtcttcagagttgtctttatatgtgaattaagttatattaaattttaatctatagtaaaaacatagtcctggaaataaattcttgcttaaatggtg

SEQ ID NO: 2 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuccggccagugagaaagatt

SEQ ID NO: 3 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuuucucacuggccggagtt

SEQ ID NO: 4 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggcagcacagaugaaucatt

SEQ ID NO: 5 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugauucaucugugcugccatt

SEQ ID NO: 6 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagugugguuagugugaaatt

SEQ ID NO: 7 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuucacacuaaccacacugtt

SEQ ID NO: 8 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caucaugcaaaagcaaagatt

SEQ ID NO: 9 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuuugcuuuugcaugaugtt

SEQ ID NO: 10 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaagagugucucaucuucutt

SEQ ID NO: 11 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaagaugagacacucuuutt

SEQ ID NO: 12 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagagugucucaucuucuutt

SEQ ID NO: 13 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagaagaugagacacucuutt

SEQ ID NO: 14 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuguuuccacuuuucagutt

SEQ ID NO: 15 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acugaaaaguggaaacagatt

SEQ ID NO: 16 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuuuucaguaugaucguutt

SEQ ID NO: 17 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacgaucauacugaaaagutt

SEQ ID NO: 18 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuucaguaugaucguuucutt

SEQ ID NO: 19 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaaacgaucauacugaaatt

SEQ ID NO: 20 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucaguaugaucguuucuutt

SEQ ID NO: 21 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagaaacgaucauacugaatt

SEQ ID NO: 22 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaguaugaucguuucuuutt

SEQ ID NO: 23 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaagaaacgaucauacugatt

SEQ ID NO: 24 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaugaucguuucuuugagatt

SEQ ID NO: 25 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucaaagaaacgaucauatt

SEQ ID NO: 26 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaccacaccuaucgaguutt

SEQ ID NO: 27 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacucgauagguguggucatt

SEQ ID NO: 28 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accacaccuaucgaguuuutt

SEQ ID NO: 29 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaacucgauagguguggutt

SEQ ID NO: 30 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggcagaugacuauucagatt

SEQ ID NO: 31 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugaauagucaucugccatt

SEQ ID NO: 32 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuggugcaguaaugacuatt

SEQ ID NO: 33 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagucauuacugcaccagatt

SEQ ID NO: 34 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguggggcaguuauggacatt

SEQ ID NO: 35 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguccauaacugccccacatt

SEQ ID NO: 36 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggacacuuugaaacaacatt

SEQ ID NO: 37 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguuguuucaaaguguccatt

SEQ ID NO: 38 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auauuucuggaacuaguaatt

SEQ ID NO: 39 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuacuaguuccagaaauautt

SEQ ID NO: 40 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuucuggaacuaguaaautt

SEQ ID NO: 41 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuuacuaguuccagaaautt

SEQ ID NO: 42 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuucuggaacuaguaaauutt

SEQ ID NO: 43 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauuuacuaguuccagaaatt

SEQ ID NO: 44 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuggaacuaguaaauuccatt

SEQ ID NO: 45 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggaauuuacuaguuccagtt

SEQ ID NO: 46 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugugagauuuacucugauutt

SEQ ID NO: 47 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaucagaguaaaucucacatt

SEQ ID NO: 48 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auccaagggauucgaaacatt

SEQ ID NO: 49 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguuucgaaucccuuggautt

SEQ ID NO: 50 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agccgagugccaaaguacatt

SEQ ID NO: 51 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguacuuuggcacucggcutt

SEQ ID NO: 52 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuugaaacuguccauucaatt

SEQ ID NO: 53 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugaauggacaguuucaaatt

SEQ ID NO: 54 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugauguggcccaugaguuutt

SEQ ID NO: 55 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaacucaugggccacaucatt

SEQ ID NO: 56 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucaugccaaaaauggacatt

SEQ ID NO: 57 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguccauuuuuggcaugactt

SEQ ID NO: 58 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaaaaauggacaucauuutt

SEQ ID NO: 59 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaugauguccauuuuuggtt

SEQ ID NO: 60 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acgaguucucugauugacatt

SEQ ID NO: 61 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucaaucagagaacucgutt

SEQ ID NO: 62 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagucugugaugaacuaautt

SEQ ID NO: 63 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuaguucaucacagacuutt

SEQ ID NO: 64 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugugaugaacuaaugagcatt

SEQ ID NO: 65 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcucauuaguucaucacatt

SEQ ID NO: 66 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaaugagcagacauaacautt

SEQ ID NO: 67 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auguuaugucugcucauuatt

SEQ ID NO: 68 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuugaagugaugagugaaatt

SEQ ID NO: 69 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuucacucaucacuucaaatt

SEQ ID NO: 70 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggcuugagcaaguugguatt

SEQ ID NO: 71 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaccaacuugcucaagccutt

SEQ ID NO: 72 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuucagaguugucuuuautt

SEQ ID NO: 73 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auaaagacaacucugaagatt

SEQ ID NO: 74 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagaguugucuuuauaugutt

SEQ ID NO: 75 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acauauaaagacaacucugtt

SEQ ID NO: 76 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaguugucuuuauaugugatt

SEQ ID NO: 77 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucacauauaaagacaacuctt

SEQ ID NO: 78 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguugucuuuauaugugaatt

SEQ ID NO: 79 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucacauauaaagacaacutt

SEQ ID NO: 80 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuauauuaaauuuuaaucutt

SEQ ID NO: 81 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agauuaaaauuuaauauaatt

SEQ ID NO: 82 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauuuuaaucuauaguaaatt

SEQ ID NO: 83 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuacuauagauuaaaauutt

SEQ ID NO: 84 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuuuaaucuauaguaaaatt

SEQ ID NO: 85 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuacuauagauuaaaautt

SEQ ID NO: 86 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguccuggaaauaaauucutt

SEQ ID NO: 87 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaauuuauuuccaggacutt

SEQ ID NO: 88 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcccauucuuaucccgatt

SEQ ID NO: 89 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgggauaagaaugggcagtt

SEQ ID NO: 90 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccagugugguuagugugaatt

SEQ ID NO: 91 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucacacuaaccacacuggtt

SEQ ID NO: 92 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucuggugcaguaaugacutt

SEQ ID NO: 93 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agucauuacugcaccagactt

SEQ ID NO: 94 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcacucuuguuuuccucgutt

SEQ ID NO: 95 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acgaggaaaacaagagugctt

SEQ ID NO: 96 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaguuuggagcaaucaccutt

SEQ ID NO: 97 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggugauugcuccaaacuctt

SEQ ID NO: 98 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcuugagcaaguugguautt

SEQ ID NO: 99 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auaccaacuugcucaagcctt

SEQ ID NO: 100 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcaaaucucuguuguucutt

SEQ ID NO: 101 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaacaacagagauuugcctt

SEQ ID NO: 102 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcaaaucucuguuguucutt

SEQ ID NO: 103 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaacaacagagauuugcctt

SEQ ID NO: 104 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caaagaccagaaagagugutt

SEQ ID NO: 105 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acacucuuucuggucuuugtt

SEQ ID NO: 106 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggugcaguaaugacuaccutt

SEQ ID NO: 107 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agguagucauuacugcacctt

SEQ ID NO: 108 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuguuuuccucgugcuuutt

SEQ ID NO: 109 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaagcacgaggaaaacaagtt

SEQ ID NO: 110 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggggaucgggauggagucatt

SEQ ID NO: 111 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugacuccaucccgaucccctt

SEQ ID NO: 112 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuugagcaaguugguaucutt

SEQ ID NO: 113 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agauaccaacuugcucaagtt

SEQ ID NO: 114 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccccaagaugauggaaguutt

SEQ ID NO: 115 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacuuccaucaucuuggggtt

SEQ ID NO: 116 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccccaagaugauggaaguutt

SEQ ID NO: 117 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacuuccaucaucuuggggtt

SEQ ID NO: 118 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucaucuucuucaagauaatt

SEQ ID NO: 119 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaucuugaagaagaugagtt

SEQ ID NO: 120 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggggcaguuauggacacuutt

SEQ ID NO: 121 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaguguccauaacugcccctt

SEQ ID NO: 122 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaugccaggcugugagauutt

SEQ ID NO: 123 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaucucacagccuggcauctt

SEQ ID NO: 124 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagacagaugcuaauggautt

SEQ ID NO: 125 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auccauuagcaucugucuctt

SEQ ID NO: 126 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccccaggccauuaucauautt

SEQ ID NO: 127 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auaugauaauggccuggggtt

SEQ ID NO: 128 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagcaguacacuaccaacatt

SEQ ID NO: 129 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguugguaguguacugcugtt

SEQ ID NO: 130 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagcaguacacuaccaacatt

SEQ ID NO: 131 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguugguaguguacugcugtt

SEQ ID NO: 132 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuguuuccacuuuucaguatt

SEQ ID NO: 133 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacugaaaaguggaaacagtt

SEQ ID NO: 134 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggacacuuugaaacaacautt

SEQ ID NO: 135 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auguuguuucaaagugucctt

SEQ ID NO: 136 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugugagauuuacucugautt

SEQ ID NO: 137 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucagaguaaaucucacagtt

SEQ ID NO: 138 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccugugcggguugcagautt

SEQ ID NO: 139 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucugcaacccgcacagggtt

SEQ ID NO: 140 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucuucagaguugucuuuatt

SEQ ID NO: 141 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaaagacaacucugaagactt

SEQ ID NO: 142 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacugcaagcaaaugcccutt

SEQ ID NO: 143 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agggcauuugcuugcagugtt

SEQ ID NO: 144 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacuuuucaguaugaucgutt

SEQ ID NO: 145 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acgaucauacugaaaagugtt

SEQ ID NO: 146 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggggcaggugguacuagaatt

SEQ ID NO: 147 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucuaguaccaccugcccctt

SEQ ID NO: 148 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaaccaugccuccaugautt

SEQ ID NO: 149 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucauggaggcaugguucctt

SEQ ID NO: 150 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucugugaugaacuaaugatt

SEQ ID NO: 151 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucauuaguucaucacagactt

SEQ ID NO: 152 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guugucuuuauaugugaautt

SEQ ID NO: 153 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auucacauauaaagacaactt

SEQ ID NO: 154 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcagcacagaugaaucagatt

SEQ ID NO: 155 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugauucaucugugcugctt

SEQ ID NO: 156 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuuucaguaugaucguuutt

SEQ ID NO: 157 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaacgaucauacugaaaagtt

SEQ ID NO: 158 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggcaggugguacuagaaatt

SEQ ID NO: 159 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuucuaguaccaccugccctt

SEQ ID NO: 160 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guccccaagauuguggcautt

SEQ ID NO: 161 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augccacaaucuuggggactt

SEQ ID NO: 162 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuaaugagcagacauaacatt

SEQ ID NO: 163 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguuaugucugcucauuagtt

SEQ ID NO: 164 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccccagugugguuagugutt

SEQ ID NO: 165 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acacuaaccacacuggggctt

SEQ ID NO: 166 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaucguuucuuugagaaaatt

SEQ ID NO: 167 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuucucaaagaaacgauctt

SEQ ID NO: 168 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcaggugguacuagaaautt

SEQ ID NO: 169 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuucuaguaccaccugcctt

SEQ ID NO: 170 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugauguggcccaugaguutt

SEQ ID NO: 171 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacucaugggccacaucactt

SEQ ID NO: 172 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caagcaaucaauuacccuatt

SEQ ID NO: 173 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaggguaauugauugcuugtt

SEQ ID NO: 174 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccagugugguuagugugatt

SEQ ID NO: 175 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucacacuaaccacacugggtt

SEQ ID NO: 176 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaccacaccuaucgaguuutt

SEQ ID NO: 177 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaacucgauaggugugguctt

SEQ ID NO: 178 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaacuaguaaauuccaugutt

SEQ ID NO: 179 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acauggaauuuacuaguuctt

SEQ ID NO: 180 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caugaguuuggagcaaucatt

SEQ ID NO: 181 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugauugcuccaaacucaugtt

SEQ ID NO: 182 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccccagaugaugaacuacutt

SEQ ID NO: 183 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguaguucaucaucuggggtt

SEQ ID NO: 184 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcccauucuuaucccgagutt

SEQ ID NO: 185 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgggauaagaaugggctt

SEQ ID NO: 186 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuccaugauccaagggautt

SEQ ID NO: 187 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucccuuggaucauggaggtt

SEQ ID NO: 188 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucaugccaaaaauggacatt

SEQ ID NO: 189 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguccauuuuuggcaugactt

SEQ ID NO: 190 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augccaaaaauggacaucatt

SEQ ID NO: 191 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugauguccauuuuuggcautt

SEQ ID NO: 192 - RNA, 19 nt, Homo sapiens
cuccggccagugagaaaga

SEQ ID NO: 193 - RNA, 19 nt, Homo sapiens
ucuuucucacuggccggag

SEQ ID NO: 194 - RNA, 19 nt, Homo sapiens
uggcagcacagaugaauca

SEQ ID NO: 195 - RNA, 19 nt, Homo sapiens
ugauucaucugugcugcca

SEQ ID NO: 196 - RNA, 19 nt, Homo sapiens
cagugugguuagugugaaa

SEQ ID NO: 197 - RNA, 19 nt, Homo sapiens
uuucacacuaaccacacug

SEQ ID NO: 198 - RNA, 19 nt, Homo sapiens
caucaugcaaaagcaaaga

SEQ ID NO: 199 - RNA, 19 nt, Homo sapiens
ucuuugcuuuugcaugaug

SEQ ID NO: 200 - RNA, 19 nt, Homo sapiens
aaagagugucucaucuucu

SEQ ID NO: 201 - RNA, 19 nt, Homo sapiens
agaagaugagacacucuuu

SEQ ID NO: 202 - RNA, 19 nt, Homo sapiens
aagagugucucaucuucuu

SEQ ID NO: 203 - RNA, 19 nt, Homo sapiens
aagaagaugagacacucuu

SEQ ID NO: 204 - RNA, 19 nt, Homo sapiens
ucuguuuccacuuuucagu

SEQ ID NO: 205 - RNA, 19 nt, Homo sapiens
acugaaaaguggaaacaga

SEQ ID NO: 206 - RNA, 19 nt, Homo sapiens
acuuuucaguaugaucguu

SEQ ID NO: 207 - RNA, 19 nt, Homo sapiens
aacgaucauacugaaaagu

SEQ ID NO: 208 - RNA, 19 nt, Homo sapiens
uuucaguaugaucguuucu

SEQ ID NO: 209 - RNA, 19 nt, Homo sapiens
agaaacgaucauacugaaa

SEQ ID NO: 210 - RNA, 19 nt, Homo sapiens
uucaguaugaucguuucuu

SEQ ID NO: 211 - RNA, 19 nt, Homo sapiens
aagaaacgaucauacugaa

SEQ ID NO: 212 - RNA, 19 nt, Homo sapiens
ucaguaugaucguuucuuu

SEQ ID NO: 213 - RNA, 19 nt, Homo sapiens
aaagaaacgaucauacuga

SEQ ID NO: 214 - RNA, 19 nt, Homo sapiens
uaugaucguuucuuugaga

SEQ ID NO: 215 - RNA, 19 nt, Homo sapiens
ucucaaagaaacgaucaua

SEQ ID NO: 216 - RNA, 19 nt, Homo sapiens
ugaccacaccuaucgaguu

SEQ ID NO: 217 - RNA, 19 nt, Homo sapiens
aacucgauaggugugguca

SEQ ID NO: 218 - RNA, 19 nt, Homo sapiens
accacaccuaucgaguuuu

SEQ ID NO: 219 - RNA, 19 nt, Homo sapiens
aaaacucgauagguguggu

SEQ ID NO: 220 - RNA, 19 nt, Homo sapiens
uggcagaugacuauucaga

SEQ ID NO: 221 - RNA, 19 nt, Homo sapiens
ucugaauagucaucugcca

SEQ ID NO: 222 - RNA, 19 nt, Homo sapiens
ucuggugcaguaaugacua

SEQ ID NO: 223 - RNA, 19 nt, Homo sapiens
uagucauuacugcaccaga

SEQ ID NO: 224 - RNA, 19 nt, Homo sapiens
uguggggcaguuauggaca

SEQ ID NO: 225 - RNA, 19 nt, Homo sapiens
uguccauaacugccccaca

SEQ ID NO: 226 - RNA, 19 nt, Homo sapiens
uggacacuuugaaacaaca

SEQ ID NO: 227 - RNA, 19 nt, Homo sapiens
uguuguuucaaagugucca

SEQ ID NO: 228 - RNA, 19 nt, Homo sapiens
auauuucuggaacuaguaa

SEQ ID NO: 229 - RNA, 19 nt, Homo sapiens
uuacuaguuccagaaauau

SEQ ID NO: 230 - RNA, 19 nt, Homo sapiens
auuucuggaacuaguaaau

SEQ ID NO: 231 - RNA, 19 nt, Homo sapiens
auuuacuaguuccagaaau

SEQ ID NO: 232 - RNA, 19 nt, Homo sapiens
uuucuggaacuaguaaauu

SEQ ID NO: 233 - RNA, 19 nt, Homo sapiens
aauuuacuaguuccagaaa

SEQ ID NO: 234 - RNA, 19 nt, Homo sapiens
cuggaacuaguaaauucca

SEQ ID NO: 235 - RNA, 19 nt, Homo sapiens
uggaauuuacuaguuccag

SEQ ID NO: 236 - RNA, 19 nt, Homo sapiens
ugugagauuuacucugauu

SEQ ID NO: 237 - RNA, 19 nt, Homo sapiens
aaucagaguaaaucucaca

SEQ ID NO: 238 - RNA, 19 nt, Homo sapiens
auccaagggauucgaaaca

SEQ ID NO: 239 - RNA, 19 nt, Homo sapiens
uguuucgaaucccuuggau

SEQ ID NO: 240 - RNA, 19 nt, Homo sapiens
agccgagugccaaaguaca

SEQ ID NO: 241 - RNA, 19 nt, Homo sapiens
uguacuuuggcacucggcu

SEQ ID NO: 242 - RNA, 19 nt, Homo sapiens
uuugaaacuguccauucaa

SEQ ID NO: 243 - RNA, 19 nt, Homo sapiens
uugaauggacaguuucaaa

SEQ ID NO: 244 - RNA, 19 nt, Homo sapiens
ugauguggcccaugaguuu

SEQ ID NO: 245 - RNA, 19 nt, Homo sapiens
aaacucaugggccacauca

SEQ ID NO: 246 - RNA, 19 nt, Homo sapiens
gucaugccaaaaauggaca

SEQ ID NO: 247 - RNA, 19 nt, Homo sapiens
uguccauuuuuggcaugac

SEQ ID NO: 248 - RNA, 19 nt, Homo sapiens
ccaaaaauggacaucauuu

SEQ ID NO: 249 - RNA, 19 nt, Homo sapiens
aaaugauguccauuuuugg

SEQ ID NO: 250 - RNA, 19 nt, Homo sapiens
acgaguucucugauugaca

SEQ ID NO: 251 - RNA, 19 nt, Homo sapiens
ugucaaucagagaacucgu

SEQ ID NO: 252 - RNA, 19 nt, Homo sapiens
aagucugugaugaacuaau

SEQ ID NO: 253 - RNA, 19 nt, Homo sapiens
auuaguucaucacagacuu

SEQ ID NO: 254 - RNA, 19 nt, Homo sapiens
ugugaugaacuaaugagca

SEQ ID NO: 255 - RNA, 19 nt, Homo sapiens
ugcucauuaguucaucaca

SEQ ID NO: 256 - RNA, 19 nt, Homo sapiens
uaaugagcagacauaacau

SEQ ID NO: 257 - RNA, 19 nt, Homo sapiens
auguuaugucugcucauua

SEQ ID NO: 258 - RNA, 19 nt, Homo sapiens
uuugaagugaugagugaaa

SEQ ID NO: 259 - RNA, 19 nt, Homo sapiens
uuucacucaucacuucaaa

SEQ ID NO: 260 - RNA, 19 nt, Homo sapiens
aggcuugagcaaguuggua

SEQ ID NO: 261 - RNA, 19 nt, Homo sapiens
uaccaacuugcucaagccu

SEQ ID NO: 262 - RNA, 19 nt, Homo sapiens
ucuucagaguugucuuuau

SEQ ID NO: 263 - RNA, 19 nt, Homo sapiens
auaaagacaacucugaaga

SEQ ID NO: 264 - RNA, 19 nt, Homo sapiens
cagaguugucuuuauaugu

SEQ ID NO: 265 - RNA, 19 nt, Homo sapiens
acauauaaagacaacucug

SEQ ID NO: 266 - RNA, 19 nt, Homo sapiens
gaguugucuuuauauguga

SEQ ID NO: 267 - RNA, 19 nt, Homo sapiens
ucacauauaaagacaacuc

SEQ ID NO: 268 - RNA, 19 nt, Homo sapiens
aguugucuuuauaugugaa

SEQ ID NO: 269 - RNA, 19 nt, Homo sapiens
uucacauauaaagacaacu

SEQ ID NO: 270 - RNA, 19 nt, Homo sapiens
uuauauuaaauuuuaaucu

SEQ ID NO: 271 - RNA, 19 nt, Homo sapiens
agauuaaaauuuaauauaa

SEQ ID NO: 272 - RNA, 19 nt, Homo sapiens
aauuuuaaucuauaguaaa

SEQ ID NO: 273 - RNA, 19 nt, Homo sapiens
uuuacuauagauuaaaauu

SEQ ID NO: 274 - RNA, 19 nt, Homo sapiens
auuuuaaucuauaguaaaa

SEQ ID NO: 275 - RNA, 19 nt, Homo sapiens
uuuuacuauagauuaaaau

SEQ ID NO: 276 - RNA, 19 nt, Homo sapiens
aguccuggaaauaaauucu

SEQ ID NO: 277 - RNA, 19 nt, Homo sapiens
agaauuuauuuccaggacu

SEQ ID NO: 278 - RNA, 19 nt, Homo sapiens
cugcccauucuuaucccga

SEQ ID NO: 279 - RNA, 19 nt, Homo sapiens
ucgggauaagaaugggcag

SEQ ID NO: 280 - RNA, 19 nt, Homo sapiens
ccagugugguuagugugaa

SEQ ID NO: 281 - RNA, 19 nt, Homo sapiens
uucacacuaaccacacugg

SEQ ID NO: 282 - RNA, 19 nt, Homo sapiens
gucuggugcaguaaugacu

SEQ ID NO: 283 - RNA, 19 nt, Homo sapiens
agucauuacugcaccagac

SEQ ID NO: 284 - RNA, 19 nt, Homo sapiens
gcacucuuguuuuccucgu

SEQ ID NO: 285 - RNA, 19 nt, Homo sapiens
acgaggaaaacaagagugc

SEQ ID NO: 286 - RNA, 19 nt, Homo sapiens
gaguuuggagcaaucaccu

SEQ ID NO: 287 - RNA, 19 nt, Homo sapiens
aggugauugcuccaaacuc

SEQ ID NO: 288 - RNA, 19 nt, Homo sapiens
ggcuugagcaaguugguau

SEQ ID NO: 289 - RNA, 19 nt, Homo sapiens
auaccaacuugcucaagcc

SEQ ID NO: 290 - RNA, 19 nt, Homo sapiens
ggcaaaucucuguuguucu

SEQ ID NO: 291 - RNA, 19 nt, Homo sapiens
agaacaacagagauuugcc

SEQ ID NO: 292 - RNA, 19 nt, Homo sapiens
ggcaaaucucuguuguucu

SEQ ID NO: 293 - RNA, 19 nt, Homo sapiens
agaacaacagagauuugcc

SEQ ID NO: 294 - RNA, 19 nt, Homo sapiens
caaagaccagaaagagugu

SEQ ID NO: 295 - RNA, 19 nt, Homo sapiens
acacucuuucuggucuuug

SEQ ID NO: 296 - RNA, 19 nt, Homo sapiens
ggugcaguaaugacuaccu

SEQ ID NO: 297 - RNA, 19 nt, Homo sapiens
agguagucauuacugcacc

SEQ ID NO: 298 - RNA, 19 nt, Homo sapiens
cuuguuuuccucgugcuuu

SEQ ID NO: 299 - RNA, 19 nt, Homo sapiens
aaagcacgaggaaaacaag

SEQ ID NO: 300 - RNA, 19 nt, Homo sapiens
ggggaucgggauggaguca

SEQ ID NO: 301 - RNA, 19 nt, Homo sapiens
ugacuccaucccgaucccc

SEQ ID NO: 302 - RNA, 19 nt, Homo sapiens
cuugagcaaguugguaucu

SEQ ID NO: 303 - RNA, 19 nt, Homo sapiens
agauaccaacuugcucaag

SEQ ID NO: 304 - RNA, 19 nt, Homo sapiens
ccccaagaugauggaaguu

SEQ ID NO: 305 - RNA, 19 nt, Homo sapiens
aacuuccaucaucuugggg

SEQ ID NO: 306 - RNA, 19 nt, Homo sapiens
ccccaagaugauggaaguu

SEQ ID NO: 307 - RNA, 19 nt, Homo sapiens
aacuuccaucaucuugggg

SEQ ID NO: 308 - RNA, 19 nt, Homo sapiens
cucaucuucuucaagauaa

SEQ ID NO: 309 - RNA, 19 nt, Homo sapiens
uuaucuugaagaagaugag

SEQ ID NO: 310 - RNA, 19 nt, Homo sapiens
ggggcaguuauggacacuu

SEQ ID NO: 311 - RNA, 19 nt, Homo sapiens
aaguguccauaacugcccc

SEQ ID NO: 312 - RNA, 19 nt, Homo sapiens
gaugccaggcugugagauu

SEQ ID NO: 313 - RNA, 19 nt, Homo sapiens
aaucucacagccuggcauc

SEQ ID NO: 314 - RNA, 19 nt, Homo sapiens
gagacagaugcuaauggau

SEQ ID NO: 315 - RNA, 19 nt, Homo sapiens
auccauuagcaucugucuc

SEQ ID NO: 316 - RNA, 19 nt, Homo sapiens
ccccaggccauuaucauau

SEQ ID NO: 317 - RNA, 19 nt, Homo sapiens
auaugauaauggccugggg

SEQ ID NO: 318 - RNA, 19 nt, Homo sapiens
cagcaguacacuaccaaca

SEQ ID NO: 319 - RNA, 19 nt, Homo sapiens
uguugguaguguacugcug

SEQ ID NO: 320 - RNA, 19 nt, Homo sapiens
cagcaguacacuaccaaca

SEQ ID NO: 321 - RNA, 19 nt, Homo sapiens
uguugguaguguacugcug

SEQ ID NO: 322 - RNA, 19 nt, Homo sapiens
cuguuuccacuuuucagua

SEQ ID NO: 323 - RNA, 19 nt, Homo sapiens
uacugaaaaguggaaacag

SEQ ID NO: 324 - RNA, 19 nt, Homo sapiens
ggacacuuugaaacaacau

SEQ ID NO: 325 - RNA, 19 nt, Homo sapiens
auguuguuucaaagugucc

SEQ ID NO: 326 - RNA, 19 nt, Homo sapiens
cugugagauuuacucugau

SEQ ID NO: 327 - RNA, 19 nt, Homo sapiens
aucagaguaaaucucacag

SEQ ID NO: 328 - RNA, 19 nt, Homo sapiens
cccugugcggguugcagau

SEQ ID NO: 329 - RNA, 19 nt, Homo sapiens
aucugcaacccgcacaggg

SEQ ID NO: 330 - RNA, 19 nt, Homo sapiens
gucuucagaguugucuuua

SEQ ID NO: 331 - RNA, 19 nt, Homo sapiens
uaaagacaacucugaagac

SEQ ID NO: 332 - RNA, 19 nt, Homo sapiens
cacugcaagcaaaugcccu

SEQ ID NO: 333 - RNA, 19 nt, Homo sapiens
agggcauuugcuugcagug

SEQ ID NO: 334 - RNA, 19 nt, Homo sapiens
cacuuuucaguaugaucgu

SEQ ID NO: 335 - RNA, 19 nt, Homo sapiens
acgaucauacugaaaagug

SEQ ID NO: 336 - RNA, 19 nt, Homo sapiens
ggggcaggugguacuagaa

SEQ ID NO: 337 - RNA, 19 nt, Homo sapiens
uucuaguaccaccugcccc

SEQ ID NO: 338 - RNA, 19 nt, Homo sapiens
ggaaccaugccuccaugau

SEQ ID NO: 339 - RNA, 19 nt, Homo sapiens
aucauggaggcaugguucc

SEQ ID NO: 340 - RNA, 19 nt, Homo sapiens
gucugugaugaacuaauga

SEQ ID NO: 341 - RNA, 19 nt, Homo sapiens
ucauuaguucaucacagac

SEQ ID NO: 342 - RNA, 19 nt, Homo sapiens
guugucuuuauaugugaau

SEQ ID NO: 343 - RNA, 19 nt, Homo sapiens
auucacauauaaagacaac

SEQ ID NO: 344 - RNA, 19 nt, Homo sapiens
gcagcacagaugaaucaga

SEQ ID NO: 345 - RNA, 19 nt, Homo sapiens
ucugauucaucugugcugc

SEQ ID NO: 346 - RNA, 19 nt, Homo sapiens
cuuuucaguaugaucguuu

SEQ ID NO: 347 - RNA, 19 nt, Homo sapiens
aaacgaucauacugaaaag

SEQ ID NO: 348 - RNA, 19 nt, Homo sapiens
gggcaggugguacuagaaa

SEQ ID NO: 349 - RNA, 19 nt, Homo sapiens
uuucuaguaccaccugccc

SEQ ID NO: 350 - RNA, 19 nt, Homo sapiens
guccccaagauuguggcau

SEQ ID NO: 351 - RNA, 19 nt, Homo sapiens
augccacaaucuuggggac

SEQ ID NO: 352 - RNA, 19 nt, Homo sapiens
cuaaugagcagacauaaca

SEQ ID NO: 353 - RNA, 19 nt, Homo sapiens
uguuaugucugcucauuag

SEQ ID NO: 354 - RNA, 19 nt, Homo sapiens
gccccagugugguuagugu

SEQ ID NO: 355 - RNA, 19 nt, Homo sapiens
acacuaaccacacuggggc

SEQ ID NO: 356 - RNA, 19 nt, Homo sapiens
gaucguuucuuugagaaaa

SEQ ID NO: 357 - RNA, 19 nt, Homo sapiens
uuuucucaaagaaacgauc

SEQ ID NO: 358 - RNA, 19 nt, Homo sapiens
ggcaggugguacuagaaau

SEQ ID NO: 359 - RNA, 19 nt, Homo sapiens
auuucuaguaccaccugcc

SEQ ID NO: 360 - RNA, 19 nt, Homo sapiens
gugauguggcccaugaguu

SEQ ID NO: 361 - RNA, 19 nt, Homo sapiens
aacucaugggccacaucac

SEQ ID NO: 362 - RNA, 19 nt, Homo sapiens
caagcaaucaauuacccua

SEQ ID NO: 363 - RNA, 19 nt, Homo sapiens
uaggguaauugauugcuug

SEQ ID NO: 364 - RNA, 19 nt, Homo sapiens
cccagugugguuaguguga

SEQ ID NO: 365 - RNA, 19 nt, Homo sapiens
ucacacuaaccacacuggg

SEQ ID NO: 366 - RNA, 19 nt, Homo sapiens
gaccacaccuaucgaguuu

SEQ ID NO: 367 - RNA, 19 nt, Homo sapiens
aaacucgauaggugugguc

SEQ ID NO: 368 - RNA, 19 nt, Homo sapiens
gaacuaguaaauuccaugu

SEQ ID NO: 369 - RNA, 19 nt, Homo sapiens
acauggaauuuacuaguuc

SEQ ID NO: 370 - RNA, 19 nt, Homo sapiens
caugaguuuggagcaauca

SEQ ID NO: 371 - RNA, 19 nt, Homo sapiens
ugauugcuccaaacucaug

SEQ ID NO: 372 - RNA, 19 nt, Homo sapiens
ccccagaugaugaacuacu

SEQ ID NO: 373 - RNA, 19 nt, Homo sapiens
aguaguucaucaucugggg

SEQ ID NO: 374 - RNA, 19 nt, Homo sapiens
gcccauucuuaucccgagu

SEQ ID NO: 375 - RNA, 19 nt, Homo sapiens
acucgggauaagaaugggc

SEQ ID NO: 376 - RNA, 19 nt, Homo sapiens
ccuccaugauccaagggau

SEQ ID NO: 377 - RNA, 19 nt, Homo sapiens
aucccuuggaucauggagg

SEQ ID NO: 378 - RNA, 19 nt, Homo sapiens
gucaugccaaaaauggaca

SEQ ID NO: 379 - RNA, 19 nt, Homo sapiens
uguccauuuuuggcaugac

SEQ ID NO: 380 - RNA, 19 nt, Homo sapiens
augccaaaaauggacauca

SEQ ID NO: 381 - RNA, 19 nt, Homo sapiens
ugauguccauuuuuggcau

SEQ ID NO: 382 - DNA, 2458 bp, Homo sapiens
cagaagaaggcagcgcccaaggcgcatgcgcagcggtcactcccgctgtatattaaggcgccggcgatcgcggcctgaggctgctcccggacaagggcaacgagcgtttcgtttggacttctcgacttgagtgcccgcctccttcgccgccgcctctgcagtcctcagcgcagttatgcccagttcttcccgctgtggggacacgaccacggaggaatccttgcttcagggactcgggaccctgctggaccccttcctcgggtttaggggatgtggggaccaggagaaagtcaggatccctaagagtcttccctgcctggatggatgagtggcttcttctccacctagattctttccacaggagccagcatacttcctgaacatggagagtgttgttcgccgctgcccattcttatcccgagtcccccaggcctttctgcagaaagcaggcaaatctctgttgttctatgcccaaaactgccccaagatgatggaagttggggccaagccagcccctcgggcattgtccactgcagcagtacactaccaacagatcaaagaaacccctccggccagtgagaaagacaaaactgctaaggccaaggtccaacagactcctgatggatcccagcagagtccagatggcacacagcttccgtctggacaccccttgcctgccacaagccagggcactgcaagcaaatgccctttcctggcagcacagatgaatcagagaggcagcagtgtcttctgcaaagccagtcttgagcttcaggaggatgtgcaggaaatgaatgccgtgaggaaagaggttgctgaaacctcagcaggccccagtgtggttagtgtgaaaaccgatggaggggatcccagtggactgctgaagaacttccaggacatcatgcaaaagcaaagaccagaaagagtgtctcatcttcttcaagataacttgccaaaatctgtttccacttttcagtatgatcgtttctttgagaaaaaaattgatgagaaaaagaatgaccacacctatcgagtttttaaaactgtgaaccggcgagcacacatcttccccatggcagatgactattcagactccctcatcaccaaaaagcaagtgtcagtctggtgcagtaatgactacctaggaatgagtcgccacccacgggtgtgtggggcagttatggacactttgaaacaacatggtgctggggcaggtggtactagaaatatttctggaactagtaaattccatgtggacttagagcgggagctggcagacctccatgggaaagatgccgcactcttgttttcctcgtgctttgtggccaatgactcaaccctcttcaccctggctaagatgatgccaggctgtgagatttactctgattctgggaaccatgcctccatgatccaagggattcgaaacagccgagtgccaaagtacatcttccgccacaatgatgtcagccacctcagagaactgctgcaaagatctgacccctcagtccccaagattgtggcatttgaaactgtccattcaatggatggggcggtgtgcccactggaagagctgtgtgatgtggcccatgagtttggagcaatcaccttcgtggatgaggtccacgcagtggggctttatggggctcgaggcggagggattggggatcgggatggagtcatgccaaaaatggacatcatttctggaacacttggcaaagcctttggttgtgttggagggtacatcgccagcacgagttctctgattgacaccgtacggtcctatgctgctggcttcatcttcaccacctctctgccacccatgctgctggctggagccctggagtctgtgcggatcctgaagagcgctgagggacgggtgcttcgccgccagcaccagcgcaacgtcaaactcatgagacagatgctaatggatgccggcctccctgttgtccactgccccagccacatcatccctgtgcgggttgcagatgctgctaaaaacacagaagtctgtgatgaactaatgagcagacataacatctacgtgcaagcaatcaattaccctacggtgccccggggagaagagctcctacggattgcccccacccctcaccacacaccccagatgatgaactacttccttgagaatctgctagtcacatggaagcaagtggggctggaactgaagcctcattcctcagctgagtgcaacttctgcaggaggccactgcattttgaagtgatgagtgaaagagagaagtcctatttctcaggcttgagcaagttggtatctgctcaggcctgagcatgacctcaattatttcacttaaccccaggccattatcatatccagatggtcttcagagttgtctttatatgtgaattaagttatattaaattttaatctatagtaaaaacatagtcctggaaataaattcttgcttaaatggtgaaaaaa

SEQ ID NO: 383 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugugaaauuuacucugautt

SEQ ID NO: 384 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucagaguaaauuucacagtt

SEQ ID NO: 385 - RNA, 21 nt, Artificial Sequence
  source: /note="Description of Artificial Sequence: Synthetic oligonucleotide"
aagucuguuuccacuuuucaa

SEQ ID NO: 386 - RNA, 23 nt, Artificial Sequence
  source: /note="Description of Artificial Sequence: Synthetic oligonucleotide"
uugaaaaguggaaacagacuuug

SEQ ID NO: 387 - RNA, 21 nt, Artificial Sequence
  source: /note="Description of Artificial Sequence: Synthetic oligonucleotide"
acauaguagccagaauugucu

SEQ ID NO: 388 - RNA, 23 nt, Artificial Sequence
  source: /note="Description of Artificial Sequence: Synthetic oligonucleotide"
agacaauucuggcuacuaugugg

SEQ ID NO: 389 - RNA, 21 nt, Artificial Sequence
  source: /note="Description of Artificial Sequence: Synthetic oligonucleotide"
aagucuguuuccacuuuucaa

SEQ ID NO: 390 - RNA, 23 nt, Artificial Sequence
  source: /note="Description of Artificial Sequence: Synthetic oligonucleotide"
uugaaaaguggaaacagacuuug

SEQ ID NO: 391 - RNA, 21 nt, Homo sapiens
caugccaaaaauggacaucau

SEQ ID NO: 392 - RNA, 23 nt, Homo sapiens
augauguccauuuuuggcaugac

SEQ ID NO: 393 - RNA, 21 nt, Homo sapiens
uaaauuuuaaucuauaguaaa

SEQ ID NO: 394 - RNA, 23 nt, Homo sapiens
uuuacuauagauuaaaauuuaau

SEQ ID NO: 395 - RNA, 21 nt, Homo sapiens
ggcugugagauuuacucugau

SEQ ID NO: 396 - RNA, 23 nt, Homo sapiens
aucagaguaaaucucacagccug

SEQ ID NO: 397 - RNA, 21 nt, Homo sapiens
ugccaaaaauggacaucauuu

SEQ ID NO: 398 - RNA, 23 nt, Homo sapiens
aaaugauguccauuuuuggcaug

SEQ ID NO: 399 - RNA, 21 nt, Homo sapiens
augauccaagggauucgaaac

SEQ ID NO: 400 - RNA, 23 nt, Homo sapiens
guuucgaaucccuuggaucaugg

SEQ ID NO: 401 - RNA, 21 nt, Homo sapiens
acuuuucaguaugaucguuuc

SEQ ID NO: 402 - RNA, 23 nt, Homo sapiens
gaaacgaucauacugaaaagugg

SEQ ID NO: 403 - RNA, 21 nt, Homo sapiens
cccagugugguuagugugaaa

SEQ ID NO: 404 - RNA, 23 nt, Homo sapiens
uuucacacuaaccacacuggggc

SEQ ID NO: 405 - RNA, 21 nt, Homo sapiens
ugugauguggcccaugaguuu

SEQ ID NO: 406 - RNA, 23 nt, Homo sapiens
aaacucaugggccacaucacaca

SEQ ID NO: 407 - RNA, 21 nt, Homo sapiens
auuuugaagugaugagugaaa

SEQ ID NO: 408 - RNA, 23 nt, Homo sapiens
uuucacucaucacuucaaaaugc

SEQ ID NO: 409 - RNA, 21 nt, Homo sapiens
uucaguaugaucguuucuuug

SEQ ID NO: 410 - RNA, 23 nt, Homo sapiens
caaagaaacgaucauacugaaaa

SEQ ID NO: 411 - RNA, 21 nt, Homo sapiens
gaccagaaagagugucucauc

SEQ ID NO: 412 - RNA, 23 nt, Homo sapiens
gaugagacacucuuucuggucuu

SEQ ID NO: 413 - RNA, 21 nt, Homo sapiens
uucugcaaagccagucuugag

SEQ ID NO: 414 - RNA, 23 nt, Homo sapiens
cucaagacuggcuuugcagaaga

SEQ ID NO: 415 - RNA, 21 nt, Homo sapiens
caugauccaagggauucgaaa

SEQ ID NO: 416 - RNA, 23 nt, Homo sapiens
uuucgaaucccuuggaucaugga

SEQ ID NO: 417 - RNA, 21 nt, Homo sapiens
ucaugccaaaaauggacauca

SEQ ID NO: 418 - RNA, 23 nt, Homo sapiens
ugauguccauuuuuggcaugacu

SEQ ID NO: 419 - RNA, 21 nt, Homo sapiens
gcugugagauuuacucugauu

SEQ ID NO: 420 - RNA, 23 nt, Homo sapiens
aaucagaguaaaucucacagccu

SEQ ID NO: 421 - RNA, 21 nt, Homo sapiens
aagagagaaguccuauuucuc

SEQ ID NO: 422 - RNA, 23 nt, Homo sapiens
gagaaauaggacuucucucuuuc

SEQ ID NO: 423 - RNA, 21 nt, Homo sapiens
aguuauauuaaauuuuaaucu

SEQ ID NO: 424 - RNA, 23 nt, Homo sapiens
agauuaaaauuuaauauaacuua

SEQ ID NO: 425 - RNA, 21 nt, Homo sapiens
cacuuuucaguaugaucguuu

SEQ ID NO: 426 - RNA, 23 nt, Homo sapiens
aaacgaucauacugaaaagugga

SEQ ID NO: 427 - RNA, 21 nt, Homo sapiens
accagaaagagugucucaucu

SEQ ID NO: 428 - RNA, 23 nt, Homo sapiens
agaugagacacucuuucuggucu

SEQ ID NO: 429 - RNA, 21 nt, Homo sapiens
gaggaaagagguugcugaaac

SEQ ID NO: 430 - RNA, 23 nt, Homo sapiens
guuucagcaaccucuuuccucac

SEQ ID NO: 431 - RNA, 21 nt, Homo sapiens
agaccagaaagagugucucau

SEQ ID NO: 432 - RNA, 23 nt, Homo sapiens
augagacacucuuucuggucuuu

SEQ ID NO: 433 - RNA, 21 nt, Homo sapiens
aauauuucuggaacuaguaaa

SEQ ID NO: 434 - RNA, 23 nt, Homo sapiens
uuuacuaguuccagaaauauuuc

SEQ ID NO: 435 - RNA, 21 nt, Homo sapiens
aggcuugagcaaguugguauc

SEQ ID NO: 436 - RNA, 23 nt, Homo sapiens
gauaccaacuugcucaagccuga

SEQ ID NO: 437 - RNA, 21 nt, Homo sapiens
uggcagcacagaugaaucaga

SEQ ID NO: 438 - RNA, 23 nt, Homo sapiens
ucugauucaucugugcugccagg

SEQ ID NO: 439 - RNA, 21 nt, Homo sapiens
gcauuuugaagugaugaguga

SEQ ID NO: 440 - RNA, 23 nt, Homo sapiens
ucacucaucacuucaaaaugcag

SEQ ID NO: 441 - RNA, 21 nt, Homo sapiens
aaaucuguuuccacuuuucag

SEQ ID NO: 442 - RNA, 23 nt, Homo sapiens
cugaaaaguggaaacagauuuug

SEQ ID NO: 443 - RNA, 21 nt, Homo sapiens
acuaaugagcagacauaacau

SEQ ID NO: 444 - RNA, 23 nt, Homo sapiens
auguuaugucugcucauuaguuc

SEQ ID NO: 445 - RNA, 21 nt, Homo sapiens
gguacuagaaauauuucugga

SEQ ID NO: 446 - RNA, 23 nt, Homo sapiens
uccagaaauauuucuaguaccac

SEQ ID NO: 447 - RNA, 21 nt, Homo sapiens
auccugaagagcgcugaggga

SEQ ID NO: 448 - RNA, 23 nt, Homo sapiens
ucccucagcgcucuucaggaucc

SEQ ID NO: 449 - RNA, 21 nt, Homo sapiens
cuucuucaagauaacuugcca

SEQ ID NO: 450 - RNA, 23 nt, Homo sapiens
uggcaaguuaucuugaagaagau

SEQ ID NO: 451 - RNA, 21 nt, Homo sapiens
gaaagagugucucaucuucuu

SEQ ID NO: 452 - RNA, 23 nt, Homo sapiens
aagaagaugagacacucuuucug

SEQ ID NO: 453 - RNA, 21 nt, Homo sapiens
augaucguuucuuugagaaaa

SEQ ID NO: 454 - RNA, 23 nt, Homo sapiens
uuuucucaaagaaacgaucauac

SEQ ID NO: 455 - RNA, 21 nt, Homo sapiens
gaacuaaugagcagacauaac

SEQ ID NO: 456 - RNA, 23 nt, Homo sapiens
guuaugucugcucauuaguucau

SEQ ID NO: 457 - RNA, 21 nt, Homo sapiens
cauuugaaacuguccauucaa

SEQ ID NO: 458 - RNA, 23 nt, Homo sapiens
uugaauggacaguuucaaaugcc

SEQ ID NO: 459 - RNA, 21 nt, Homo sapiens
uaguaaaaacauaguccugga

SEQ ID NO: 460 - RNA, 23 nt, Homo sapiens
uccaggacuauguuuuuacuaua

SEQ ID NO: 461 - RNA, 21 nt, Homo sapiens
gacaucaugcaaaagcaaaga

SEQ ID NO: 462 - RNA, 23 nt, Homo sapiens
ucuuugcuuuugcaugauguccu

SEQ ID NO: 463 - RNA, 21 nt, Homo sapiens
gucugugaugaacuaaugagc

SEQ ID NO: 464 - RNA, 23 nt, Homo sapiens
gcucauuaguucaucacagacuu

SEQ ID NO: 465 - RNA, 21 nt, Homo sapiens
uuucaguaugaucguuucuuu

SEQ ID NO: 466 - RNA, 23 nt, Homo sapiens
aaagaaacgaucauacugaaaag

SEQ ID NO: 467 - RNA, 21 nt, Homo sapiens
auuucuggaacuaguaaauuc

SEQ ID NO: 468 - RNA, 23 nt, Homo sapiens
gaauuuacuaguuccagaaauau

SEQ ID NO: 469 - RNA, 21 nt, Homo sapiens
ucuggaacuaguaaauuccau

SEQ ID NO: 470 - RNA, 23 nt, Homo sapiens
auggaauuuacuaguuccagaaa

SEQ ID NO: 471 - RNA, 21 nt, Homo sapiens
aaugaccacaccuaucgaguu

SEQ ID NO: 472 - RNA, 23 nt, Homo sapiens
aacucgauagguguggucauucu

SEQ ID NO: 473 - RNA, 21 nt, Homo sapiens
ccuaucgaguuuuuaaaacug

SEQ ID NO: 474 - RNA, 23 nt, Homo sapiens
caguuuuaaaaacucgauaggug

SEQ ID NO: 475 - RNA, 21 nt, Homo sapiens
uauuucuggaacuaguaaauu

SEQ ID NO: 476 - RNA, 23 nt, Homo sapiens
aauuuacuaguuccagaaauauu

SEQ ID NO: 477 - RNA, 21 nt, Homo sapiens
aaauuuuaaucuauaguaaaa

SEQ ID NO: 478 - RNA, 23 nt, Homo sapiens
uuuuacuauagauuaaaauuuaa

SEQ ID NO: 479 - RNA, 21 nt, Homo sapiens
cagaaagagugucucaucuuc

SEQ ID NO: 480 - RNA, 23 nt, Homo sapiens
gaagaugagacacucuuucuggu

SEQ ID NO: 481 - RNA, 19 nt, Homo sapiens
gcccauucuuaucccgagu

SEQ ID NO: 482 - RNA, 19 nt, Homo sapiens
acucgggauaagaaugggc

SEQ ID NO: 483 - RNA, 19 nt, Homo sapiens
caaaacugccccaagauga

SEQ ID NO: 484 - RNA, 19 nt, Homo sapiens
ucaucuuggggcaguuuug

SEQ ID NO: 485 - RNA, 19 nt, Homo sapiens
cagaaagagugucucaucu

SEQ ID NO: 486 - RNA, 19 nt, Homo sapiens
agaugagacacucuuucug

SEQ ID NO: 487 - RNA, 19 nt, Homo sapiens
agaaagagugucucaucuu

SEQ ID NO: 488 - RNA, 19 nt, Homo sapiens
aagaugagacacucuuucu

SEQ ID NO: 489 - RNA, 19 nt, Homo sapiens
aagagugucucaucuucuu

SEQ ID NO: 490 - RNA, 19 nt, Homo sapiens
aagaagaugagacacucuu

SEQ ID NO: 491 - RNA, 19 nt, Homo sapiens
cucuucacccuggcuaaga

SEQ ID NO: 492 - RNA, 19 nt, Homo sapiens
ucuuagccagggugaagag

SEQ ID NO: 493 - RNA, 19 nt, Homo sapiens
ucuucacccuggcuaagau

SEQ ID NO: 494 - RNA, 19 nt, Homo sapiens
aucuuagccagggugaaga

SEQ ID NO: 495 - RNA, 19 nt, Homo sapiens
ucacccuggcuaagaugau

SEQ ID NO: 496 - RNA, 19 nt, Homo sapiens
aucaucuuagccaggguga

SEQ ID NO: 497 - RNA, 19 nt, Homo sapiens
ggaaccaugccuccaugau

SEQ ID NO: 498 - RNA, 19 nt, Homo sapiens
aucauggaggcaugguucc

SEQ ID NO: 499 - RNA, 19 nt, Homo sapiens
gccuccaugauccaaggga

SEQ ID NO: 500 - RNA, 19 nt, Homo sapiens
ucccuuggaucauggaggc

SEQ ID NO: 501 - RNA, 19 nt, Homo sapiens
ccuccaugauccaagggau

SEQ ID NO: 502 - RNA, 19 nt, Homo sapiens
aucccuuggaucauggagg

SEQ ID NO: 503 - RNA, 19 nt, Homo sapiens
cuccaugauccaagggauu

SEQ ID NO: 504 - RNA, 19 nt, Homo sapiens
aaucccuuggaucauggag

SEQ ID NO: 505 - RNA, 19 nt, Homo sapiens
gucaugccaaaaauggaca

SEQ ID NO: 506 - RNA, 19 nt, Homo sapiens
uguccauuuuuggcaugac

SEQ ID NO: 507 - RNA, 19 nt, Homo sapiens
augccaaaaauggacauca

SEQ ID NO: 508 - RNA, 19 nt, Homo sapiens
ugauguccauuuuuggcau

SEQ ID NO: 509 - RNA, 19 nt, Homo sapiens
ugccaaaaauggacaucau

SEQ ID NO: 510 - RNA, 19 nt, Homo sapiens
augauguccauuuuuggca

SEQ ID NO: 511 - RNA, 19 nt, Homo sapiens
cccuggagucugugcggau

SEQ ID NO: 512 - RNA, 19 nt, Homo sapiens
auccgcacagacuccaggg

SEQ ID NO: 513 - RNA, 19 nt, Homo sapiens
uggagucugugcggauccu

SEQ ID NO: 514 - RNA, 19 nt, Homo sapiens
aggauccgcacagacucca

SEQ ID NO: 515 - RNA, 19 nt, Homo sapiens
caucaucccugugcggguu

SEQ ID NO: 516 - RNA, 19 nt, Homo sapiens
aacccgcacagggaugaug

SEQ ID NO: 517 - RNA, 19 nt, Homo sapiens
ugcccauucuuaucccgaa

SEQ ID NO: 518 - RNA, 19 nt, Homo sapiens
uucgggauaagaaugggca

SEQ ID NO: 519 - RNA, 19 nt, Homo sapiens
ccauucuuaucccgaguca

SEQ ID NO: 520 - RNA, 19 nt, Homo sapiens
ugacucgggauaagaaugg

SEQ ID NO: 521 - RNA, 19 nt, Homo sapiens
cauucuuaucccgagucca

SEQ ID NO: 522 - RNA, 19 nt, Homo sapiens
uggacucgggauaagaaug

SEQ ID NO: 523 - RNA, 19 nt, Homo sapiens
ugccccaagaugauggaau

SEQ ID NO: 524 - RNA, 19 nt, Homo sapiens
auuccaucaucuuggggca

SEQ ID NO: 525 - RNA, 19 nt, Homo sapiens
ccagaaagagugucucaua

SEQ ID NO: 526 - RNA, 19 nt, Homo sapiens
uaugagacacucuuucugg

SEQ ID NO: 527 - RNA, 19 nt, Homo sapiens
gaaagagugucucaucuua

SEQ ID NO: 528 - RNA, 19 nt, Homo sapiens
uaagaugagacacucuuuc

SEQ ID NO: 529 - RNA, 19 nt, Homo sapiens
cacccacggguguguggga

SEQ ID NO: 530 - RNA, 19 nt, Homo sapiens
ucccacacacccgugggug

SEQ ID NO: 531 - RNA, 19 nt, Homo sapiens
acccacgggugugugggga

SEQ ID NO: 532 - RNA, 19 nt, Homo sapiens
uccccacacacccgugggu

SEQ ID NO: 533 - RNA, 19 nt, Homo sapiens
cuucacccuggcuaagaua

SEQ ID NO: 534 - RNA, 19 nt, Homo sapiens
uaucuuagccagggugaag

SEQ ID NO: 535 - RNA, 19 nt, Homo sapiens
cacccuggcuaagaugaua

SEQ ID NO: 536 - RNA, 19 nt, Homo sapiens
uaucaucuuagccagggug

SEQ ID NO: 537 - RNA, 19 nt, Homo sapiens
acccuggcuaagaugauga

SEQ ID NO: 538 - RNA, 19 nt, Homo sapiens
ucaucaucuuagccagggu

SEQ ID NO: 539 - RNA, 19 nt, Homo sapiens
gaaccaugccuccaugaua

SEQ ID NO: 540 - RNA, 19 nt, Homo sapiens
uaucauggaggcaugguuc

SEQ ID NO: 541 - RNA, 19 nt, Homo sapiens
gaaacuguccauucaauga

SEQ ID NO: 542 - RNA, 19 nt, Homo sapiens
ucauugaauggacaguuuc

SEQ ID NO: 543 - RNA, 19 nt, Homo sapiens
uggagcccuggagucugua

SEQ ID NO: 544 - RNA, 19 nt, Homo sapiens
uacagacuccagggcucca

SEQ ID NO: 545 - RNA, 19 nt, Homo sapiens
ggagucugugcggauccua

SEQ ID NO: 546 - RNA, 19 nt, Homo sapiens
uaggauccgcacagacucc

SEQ ID NO: 547 - RNA, 19 nt, Homo sapiens
cacaucaucccugugcgga

SEQ ID NO: 548 - RNA, 19 nt, Homo sapiens
uccgcacagggaugaugug

SEQ ID NO: 549 - RNA, 19 nt, Homo sapiens
aucaucccugugcggguua

SEQ ID NO: 550 - RNA, 19 nt, Homo sapiens
uaacccgcacagggaugau

SEQ ID NO: 551 - RNA, 19 nt, Homo sapiens
ucaucccugugcggguuga

SEQ ID NO: 552 - RNA, 19 nt, Homo sapiens
ucaacccgcacagggauga

SEQ ID NO: 553 - RNA, 19 nt, Homo sapiens
uauauuaaggcgccggcga

SEQ ID NO: 554 - RNA, 19 nt, Homo sapiens
ucgccggcgccuuaauaua

SEQ ID NO: 555 - RNA, 19 nt, Homo sapiens
auauuaaggcgccggcgau

SEQ ID NO: 556 - RNA, 19 nt, Homo sapiens
aucgccggcgccuuaauau

SEQ ID NO: 557 - RNA, 19 nt, Homo sapiens
uauuaaggcgccggcgauc

SEQ ID NO: 558 - RNA, 19 nt, Homo sapiens
gaucgccggcgccuuaaua

SEQ ID NO: 559 - RNA, 19 nt, Homo sapiens
auuaaggcgccggcgaucg

SEQ ID NO: 560 - RNA, 19 nt, Homo sapiens
cgaucgccggcgccuuaau

SEQ ID NO: 561 - RNA, 19 nt, Homo sapiens
uuaaggcgccggcgaucgc

SEQ ID NO: 562 - RNA, 19 nt, Homo sapiens
gcgaucgccggcgccuuaa

SEQ ID NO: 563 - RNA, 19 nt, Homo sapiens
uaaggcgccggcgaucgcg

SEQ ID NO: 564 - RNA, 19 nt, Homo sapiens
cgcgaucgccggcgccuua

SEQ ID NO: 565 - RNA, 19 nt, Homo sapiens
aaggcgccggcgaucgcgg

SEQ ID NO: 566 - RNA, 19 nt, Homo sapiens
ccgcgaucgccggcgccuu

SEQ ID NO: 567 - RNA, 19 nt, Homo sapiens
aggcgccggcgaucgcggc

SEQ ID NO: 568 - RNA, 19 nt, Homo sapiens
gccgcgaucgccggcgccu

SEQ ID NO: 569 - RNA, 19 nt, Homo sapiens
ggcgccggcgaucgcggcc

SEQ ID NO: 570 - RNA, 19 nt, Homo sapiens
ggccgcgaucgccggcgcc

SEQ ID NO: 571 - RNA, 19 nt, Homo sapiens
gcgccggcgaucgcggccu

SEQ ID NO: 572 - RNA, 19 nt, Homo sapiens
aggccgcgaucgccggcgc

SEQ ID NO: 573 - RNA, 19 nt, Homo sapiens
cgccggcgaucgcggccug

SEQ ID NO: 574 - RNA, 19 nt, Homo sapiens
caggccgcgaucgccggcg

SEQ ID NO: 575 - RNA, 19 nt, Homo sapiens
cuugagugcccgccuccuu

SEQ ID NO: 576 - RNA, 19 nt, Homo sapiens
aaggaggcgggcacucaag

SEQ ID NO: 577 - RNA, 19 nt, Homo sapiens
uugagugcccgccuccuuc

SEQ ID NO: 578 - RNA, 19 nt, Homo sapiens
gaaggaggcgggcacucaa

SEQ ID NO: 579 - RNA, 19 nt, Homo sapiens
ugagugcccgccuccuucg

SEQ ID NO: 580 - RNA, 19 nt, Homo sapiens
cgaaggaggcgggcacuca

SEQ ID NO: 581 - RNA, 19 nt, Homo sapiens
gagugcccgccuccuucgc

SEQ ID NO: 582 - RNA, 19 nt, Homo sapiens
gcgaaggaggcgggcacuc

SEQ ID NO: 583 - RNA, 19 nt, Homo sapiens
agugcccgccuccuucgcc

SEQ ID NO: 584 - RNA, 19 nt, Homo sapiens
ggcgaaggaggcgggcacu

SEQ ID NO: 585 - RNA, 19 nt, Homo sapiens
gugcccgccuccuucgccg

SEQ ID NO: 586 - RNA, 19 nt, Homo sapiens
cggcgaaggaggcgggcac

SEQ ID NO: 587 - RNA, 19 nt, Homo sapiens
ugcccgccuccuucgccgc

SEQ ID NO: 588 - RNA, 19 nt, Homo sapiens
gcggcgaaggaggcgggca

SEQ ID NO: 589 - RNA, 19 nt, Homo sapiens
gcccgccuccuucgccgcc

SEQ ID NO: 590 - RNA, 19 nt, Homo sapiens
ggcggcgaaggaggcgggc

SEQ ID NO: 591 - RNA, 19 nt, Homo sapiens
cccgccuccuucgccgccg

SEQ ID NO: 592 - RNA, 19 nt, Homo sapiens
cggcggcgaaggaggcggg

SEQ ID NO: 593 - RNA, 19 nt, Homo sapiens
ccgccuccuucgccgccgc

SEQ ID NO: 594 - RNA, 19 nt, Homo sapiens
gcggcggcgaaggaggcgg

SEQ ID NO: 595 - RNA, 19 nt, Homo sapiens
cgccuccuucgccgccgcc

SEQ ID NO: 596 - RNA, 19 nt, Homo sapiens
ggcggcggcgaaggaggcg

SEQ ID NO: 597 - RNA, 19 nt, Homo sapiens
gccuccuucgccgccgccu

SEQ ID NO: 598 - RNA, 19 nt, Homo sapiens
aggcggcggcgaaggaggc

SEQ ID NO: 599 - RNA, 19 nt, Homo sapiens
ccuccuucgccgccgccuc

SEQ ID NO: 600 - RNA, 19 nt, Homo sapiens
gaggcggcggcgaaggagg

SEQ ID NO: 601 - RNA, 19 nt, Homo sapiens
cgcugcccauucuuauccc

SEQ ID NO: 602 - RNA, 19 nt, Homo sapiens
gggauaagaaugggcagcg

SEQ ID NO: 603 - RNA, 19 nt, Homo sapiens
gcugcccauucuuaucccg

SEQ ID NO: 604 - RNA, 19 nt, Homo sapiens
cgggauaagaaugggcagc

SEQ ID NO: 605 - RNA, 19 nt, Homo sapiens
ugcccauucuuaucccgag

SEQ ID NO: 606 - RNA, 19 nt, Homo sapiens
cucgggauaagaaugggca

SEQ ID NO: 607 - RNA, 19 nt, Homo sapiens
cccauucuuaucccgaguc

SEQ ID NO: 608 - RNA, 19 nt, Homo sapiens
gacucgggauaagaauggg

SEQ ID NO: 609 - RNA, 19 nt, Homo sapiens
ccauucuuaucccgagucc

SEQ ID NO: 610 - RNA, 19 nt, Homo sapiens
ggacucgggauaagaaugg

SEQ ID NO: 611 - RNA, 19 nt, Homo sapiens
cauucuuaucccgaguccc

SEQ ID NO: 612 - RNA, 19 nt, Homo sapiens
gggacucgggauaagaaug

SEQ ID NO: 613 - RNA, 19 nt, Homo sapiens
auucuuaucccgagucccc

SEQ ID NO: 614 - RNA, 19 nt, Homo sapiens
ggggacucgggauaagaau

SEQ ID NO: 615 - RNA, 19 nt, Homo sapiens
uucuuaucccgaguccccc

SEQ ID NO: 616 - RNA, 19 nt, Homo sapiens
gggggacucgggauaagaa

SEQ ID NO: 617 - RNA, 19 nt, Homo sapiens
ucuuaucccgaguccccca

SEQ ID NO: 618 - RNA, 19 nt, Homo sapiens
ugggggacucgggauaaga

SEQ ID NO: 619 - RNA, 19 nt, Homo sapiens
cuuaucccgagucccccag

SEQ ID NO: 620 - RNA, 19 nt, Homo sapiens
cugggggacucgggauaag

SEQ ID NO: 621 - RNA, 19 nt, Homo sapiens
uuaucccgagucccccagg

SEQ ID NO: 622 - RNA, 19 nt, Homo sapiens
ccugggggacucgggauaa

SEQ ID NO: 623 - RNA, 19 nt, Homo sapiens
uaucccgagucccccaggc

SEQ ID NO: 624 - RNA, 19 nt, Homo sapiens
gccugggggacucgggaua

SEQ ID NO: 625 - RNA, 19 nt, Homo sapiens
aucccgagucccccaggcc

SEQ ID NO: 626 - RNA, 19 nt, Homo sapiens
ggccugggggacucgggau

SEQ ID NO: 627 - RNA, 19 nt, Homo sapiens
ucccgagucccccaggccu

SEQ ID NO: 628 - RNA, 19 nt, Homo sapiens
aggccugggggacucggga

SEQ ID NO: 629 - RNA, 19 nt, Homo sapiens
cccgagucccccaggccuu

SEQ ID NO: 630 - RNA, 19 nt, Homo sapiens
aaggccugggggacucggg

SEQ ID NO: 631 - RNA, 19 nt, Homo sapiens
ccgagucccccaggccuuu

SEQ ID NO: 632 - RNA, 19 nt, Homo sapiens
aaaggccugggggacucgg

SEQ ID NO: 633 - RNA, 19 nt, Homo sapiens
cgagucccccaggccuuuc

SEQ ID NO: 634 - RNA, 19 nt, Homo sapiens
gaaaggccugggggacucg

SEQ ID NO: 635 - RNA, 19 nt, Homo sapiens
gagucccccaggccuuucu

SEQ ID NO: 636 - RNA, 19 nt, Homo sapiens
agaaaggccugggggacuc

SEQ ID NO: 637 - RNA, 19 nt, Homo sapiens
agucccccaggccuuucug

SEQ ID NO: 638 - RNA, 19 nt, Homo sapiens
cagaaaggccugggggacu

SEQ ID NO: 639 - RNA, 19 nt, Homo sapiens
gucccccaggccuuucugc

SEQ ID NO: 640 - RNA, 19 nt, Homo sapiens
gcagaaaggccugggggac

SEQ ID NO: 641 - RNA, 19 nt, Homo sapiens
ucccccaggccuuucugca

SEQ ID NO: 642 - RNA, 19 nt, Homo sapiens
ugcagaaaggccuggggga

SEQ ID NO: 643 - RNA, 19 nt, Homo sapiens
cccccaggccuuucugcag

SEQ ID NO: 644 - RNA, 19 nt, Homo sapiens
cugcagaaaggccuggggg

SEQ ID NO: 645 - RNA, 19 nt, Homo sapiens
ccccaggccuuucugcaga

SEQ ID NO: 646 - RNA, 19 nt, Homo sapiens
ucugcagaaaggccugggg

SEQ ID NO: 647 - RNA, 19 nt, Homo sapiens
cccaggccuuucugcagaa

SEQ ID NO: 648 - RNA, 19 nt, Homo sapiens
uucugcagaaaggccuggg

SEQ ID NO: 649 - RNA, 19 nt, Homo sapiens
ccaggccuuucugcagaaa

SEQ ID NO: 650 - RNA, 19 nt, Homo sapiens
uuucugcagaaaggccugg

SEQ ID NO: 651 - RNA, 19 nt, Homo sapiens
caggccuuucugcagaaag

SEQ ID NO: 652 - RNA, 19 nt, Homo sapiens
cuuucugcagaaaggccug

SEQ ID NO: 653 - RNA, 19 nt, Homo sapiens
aggccuuucugcagaaagc

SEQ ID NO: 654 - RNA, 19 nt, Homo sapiens
gcuuucugcagaaaggccu

SEQ ID NO: 655 - RNA, 19 nt, Homo sapiens
ggccuuucugcagaaagca

SEQ ID NO: 656 - RNA, 19 nt, Homo sapiens
ugcuuucugcagaaaggcc

SEQ ID NO: 657 - RNA, 19 nt, Homo sapiens
gccuuucugcagaaagcag

SEQ ID NO: 658 - RNA, 19 nt, Homo sapiens
cugcuuucugcagaaaggc

SEQ ID NO: 659 - RNA, 19 nt, Homo sapiens
ccuuucugcagaaagcagg

SEQ ID NO: 660 - RNA, 19 nt, Homo sapiens
ccugcuuucugcagaaagg

SEQ ID NO: 661 - RNA, 19 nt, Homo sapiens
cuuucugcagaaagcaggc

SEQ ID NO: 662 - RNA, 19 nt, Homo sapiens
gccugcuuucugcagaaag

SEQ ID NO: 663 - RNA, 19 nt, Homo sapiens
uuucugcagaaagcaggca

SEQ ID NO: 664 - RNA, 19 nt, Homo sapiens
ugccugcuuucugcagaaa

SEQ ID NO: 665 - RNA, 19 nt, Homo sapiens
uucugcagaaagcaggcaa

SEQ ID NO: 666 - RNA, 19 nt, Homo sapiens
uugccugcuuucugcagaa

SEQ ID NO: 667 - RNA, 19 nt, Homo sapiens
ucugcagaaagcaggcaaa

SEQ ID NO: 668 - RNA, 19 nt, Homo sapiens
uuugccugcuuucugcaga

SEQ ID NO: 669 - RNA, 19 nt, Homo sapiens
cugcagaaagcaggcaaau

SEQ ID NO: 670 - RNA, 19 nt, Homo sapiens
auuugccugcuuucugcag

SEQ ID NO: 671 - RNA, 19 nt, Homo sapiens
ugcagaaagcaggcaaauc

SEQ ID NO: 672 - RNA, 19 nt, Homo sapiens
gauuugccugcuuucugca

SEQ ID NO: 673 - RNA, 19 nt, Homo sapiens
gcagaaagcaggcaaaucu

SEQ ID NO: 674 - RNA, 19 nt, Homo sapiens
agauuugccugcuuucugc

SEQ ID NO: 675 - RNA, 19 nt, Homo sapiens
cagaaagcaggcaaaucuc

SEQ ID NO: 676 - RNA, 19 nt, Homo sapiens
gagauuugccugcuuucug

SEQ ID NO: 677 - RNA, 19 nt, Homo sapiens
agaaagcaggcaaaucucu

SEQ ID NO: 678 - RNA, 19 nt, Homo sapiens
agagauuugccugcuuucu

SEQ ID NO: 679 - RNA, 19 nt, Homo sapiens
gaaagcaggcaaaucucug

SEQ ID NO: 680 - RNA, 19 nt, Homo sapiens
cagagauuugccugcuuuc

SEQ ID NO: 681 - RNA, 19 nt, Homo sapiens
aaagcaggcaaaucucugu

SEQ ID NO: 682 - RNA, 19 nt, Homo sapiens
acagagauuugccugcuuu

SEQ ID NO: 683 - RNA, 19 nt, Homo sapiens
aagcaggcaaaucucuguu

SEQ ID NO: 684 - RNA, 19 nt, Homo sapiens
aacagagauuugccugcuu

SEQ ID NO: 685 - RNA, 19 nt, Homo sapiens
agcaggcaaaucucuguug

SEQ ID NO: 686 - RNA, 19 nt, Homo sapiens
caacagagauuugccugcu

SEQ ID NO: 687 - RNA, 19 nt, Homo sapiens
gcaggcaaaucucuguugu

SEQ ID NO: 688 - RNA, 19 nt, Homo sapiens
acaacagagauuugccugc

SEQ ID NO: 689 - RNA, 19 nt, Homo sapiens
caggcaaaucucuguuguu

SEQ ID NO: 690 - RNA, 19 nt, Homo sapiens
aacaacagagauuugccug

SEQ ID NO: 691 - RNA, 19 nt, Homo sapiens
aggcaaaucucuguuguuc

SEQ ID NO: 692 - RNA, 19 nt, Homo sapiens
gaacaacagagauuugccu

SEQ ID NO: 693 - RNA, 19 nt, Homo sapiens
gcaaaucucuguuguucua

SEQ ID NO: 694 - RNA, 19 nt, Homo sapiens
uagaacaacagagauuugc

SEQ ID NO: 695 - RNA, 19 nt, Homo sapiens
caaaucucuguuguucuau

SEQ ID NO: 696 - RNA, 19 nt, Homo sapiens
auagaacaacagagauuug

SEQ ID NO: 697 - RNA, 19 nt, Homo sapiens
aaaucucuguuguucuaug

SEQ ID NO: 698 - RNA, 19 nt, Homo sapiens
cauagaacaacagagauuu

SEQ ID NO: 699 - RNA, 19 nt, Homo sapiens
aaucucuguuguucuaugc

SEQ ID NO: 700 - RNA, 19 nt, Homo sapiens
gcauagaacaacagagauu

SEQ ID NO: 701 - RNA, 19 nt, Homo sapiens
aucucuguuguucuaugcc

SEQ ID NO: 702 - RNA, 19 nt, Homo sapiens
ggcauagaacaacagagau

SEQ ID NO: 703 - RNA, 19 nt, Homo sapiens
ucucuguuguucuaugccc

SEQ ID NO: 704 - RNA, 19 nt, Homo sapiens
gggcauagaacaacagaga

SEQ ID NO: 705 - RNA, 19 nt, Homo sapiens
cucuguuguucuaugccca

SEQ ID NO: 706 - RNA, 19 nt, Homo sapiens
ugggcauagaacaacagag

SEQ ID NO: 707 - RNA, 19 nt, Homo sapiens
ucuguuguucuaugcccaa

SEQ ID NO: 708 - RNA, 19 nt, Homo sapiens
uugggcauagaacaacaga

SEQ ID NO: 709 - RNA, 19 nt, Homo sapiens
cuguuguucuaugcccaaa

SEQ ID NO: 710 - RNA, 19 nt, Homo sapiens
uuugggcauagaacaacag

SEQ ID NO: 711 - RNA, 19 nt, Homo sapiens
uguuguucuaugcccaaaa

SEQ ID NO: 712 - RNA, 19 nt, Homo sapiens
uuuugggcauagaacaaca

SEQ ID NO: 713 - RNA, 19 nt, Homo sapiens
guuguucuaugcccaaaac

SEQ ID NO: 714 - RNA, 19 nt, Homo sapiens
guuuugggcauagaacaac

SEQ ID NO: 715 - RNA, 19 nt, Homo sapiens
uuguucuaugcccaaaacu

SEQ ID NO: 716 - RNA, 19 nt, Homo sapiens
aguuuugggcauagaacaa

SEQ ID NO: 717 - RNA, 19 nt, Homo sapiens
uguucuaugcccaaaacug

SEQ ID NO: 718 - RNA, 19 nt, Homo sapiens
caguuuugggcauagaaca

SEQ ID NO: 719 - RNA, 19 nt, Homo sapiens
guucuaugcccaaaacugc

SEQ ID NO: 720 - RNA, 19 nt, Homo sapiens
gcaguuuugggcauagaac

SEQ ID NO: 721 - RNA, 19 nt, Homo sapiens
uucuaugcccaaaacugcc

SEQ ID NO: 722 - RNA, 19 nt, Homo sapiens
ggcaguuuugggcauagaa

SEQ ID NO: 723 - RNA, 19 nt, Homo sapiens
ucuaugcccaaaacugccc

SEQ ID NO: 724 - RNA, 19 nt, Homo sapiens
gggcaguuuugggcauaga

SEQ ID NO: 725 - RNA, 19 nt, Homo sapiens
cuaugcccaaaacugcccc

SEQ ID NO: 726 - RNA, 19 nt, Homo sapiens
ggggcaguuuugggcauag

SEQ ID NO: 727 - RNA, 19 nt, Homo sapiens
uaugcccaaaacugcccca

SEQ ID NO: 728 - RNA, 19 nt, Homo sapiens
uggggcaguuuugggcaua

SEQ ID NO: 729 - RNA, 19 nt, Homo sapiens
augcccaaaacugccccaa

SEQ ID NO: 730 - RNA, 19 nt, Homo sapiens
uuggggcaguuuugggcau

SEQ ID NO: 731 - RNA, 19 nt, Homo sapiens
ugcccaaaacugccccaag

SEQ ID NO: 732 - RNA, 19 nt, Homo sapiens
cuuggggcaguuuugggca

SEQ ID NO: 733 - RNA, 19 nt, Homo sapiens
gcccaaaacugccccaaga

SEQ ID NO: 734 - RNA, 19 nt, Homo sapiens
ucuuggggcaguuuugggc

SEQ ID NO: 735 - RNA, 19 nt, Homo sapiens
cccaaaacugccccaagau

SEQ ID NO: 736 - RNA, 19 nt, Homo sapiens
aucuuggggcaguuuuggg

SEQ ID NO: 737 - RNA, 19 nt, Homo sapiens
ccaaaacugccccaagaug

SEQ ID NO: 738 - RNA, 19 nt, Homo sapiens
caucuuggggcaguuuugg

SEQ ID NO: 739 - RNA, 19 nt, Homo sapiens
aaaacugccccaagaugau

SEQ ID NO: 740 - RNA, 19 nt, Homo sapiens
aucaucuuggggcaguuuu

SEQ ID NO: 741 - RNA, 19 nt, Homo sapiens
aaacugccccaagaugaug

SEQ ID NO: 742 - RNA, 19 nt, Homo sapiens
caucaucuuggggcaguuu

SEQ ID NO: 743 - RNA, 19 nt, Homo sapiens
aacugccccaagaugaugg

SEQ ID NO: 744 - RNA, 19 nt, Homo sapiens
ccaucaucuuggggcaguu

SEQ ID NO: 745 - RNA, 19 nt, Homo sapiens
acugccccaagaugaugga

SEQ ID NO: 746 - RNA, 19 nt, Homo sapiens
uccaucaucuuggggcagu

SEQ ID NO: 747 - RNA, 19 nt, Homo sapiens
cugccccaagaugauggaa

SEQ ID NO: 748 - RNA, 19 nt, Homo sapiens
uuccaucaucuuggggcag

SEQ ID NO: 749 - RNA, 19 nt, Homo sapiens
ugccccaagaugauggaag

SEQ ID NO: 750 - RNA, 19 nt, Homo sapiens
cuuccaucaucuuggggca

SEQ ID NO: 751 - RNA, 19 nt, Homo sapiens
gccccaagaugauggaagu

SEQ ID NO: 752 - RNA, 19 nt, Homo sapiens
acuuccaucaucuuggggc

SEQ ID NO: 753 - RNA, 19 nt, Homo sapiens
cccaagaugauggaaguug

SEQ ID NO: 754 - RNA, 19 nt, Homo sapiens
caacuuccaucaucuuggg

SEQ ID NO: 755 - RNA, 19 nt, Homo sapiens
ccaagaugauggaaguugg

SEQ ID NO: 756 - RNA, 19 nt, Homo sapiens
ccaacuuccaucaucuugg

SEQ ID NO: 757 - RNA, 19 nt, Homo sapiens
caagaugauggaaguuggg

SEQ ID NO: 758 - RNA, 19 nt, Homo sapiens
cccaacuuccaucaucuug

SEQ ID NO: 759 - RNA, 19 nt, Homo sapiens
aagaugauggaaguugggg

SEQ ID NO: 760 - RNA, 19 nt, Homo sapiens
ccccaacuuccaucaucuu

SEQ ID NO: 761 - RNA, 19 nt, Homo sapiens
agaugauggaaguuggggc

SEQ ID NO: 762 - RNA, 19 nt, Homo sapiens
gccccaacuuccaucaucu

SEQ ID NO: 763 - RNA, 19 nt, Homo sapiens
gaugauggaaguuggggcc

SEQ ID NO: 764 - RNA, 19 nt, Homo sapiens
ggccccaacuuccaucauc

SEQ ID NO: 765 - RNA, 19 nt, Homo sapiens
augauggaaguuggggcca

SEQ ID NO: 766 - RNA, 19 nt, Homo sapiens
uggccccaacuuccaucau

SEQ ID NO: 767 - RNA, 19 nt, Homo sapiens
ugauggaaguuggggccaa

SEQ ID NO: 768 - RNA, 19 nt, Homo sapiens
uuggccccaacuuccauca

SEQ ID NO: 769 - RNA, 19 nt, Homo sapiens
gauggaaguuggggccaag

SEQ ID NO: 770 - RNA, 19 nt, Homo sapiens
cuuggccccaacuuccauc

SEQ ID NO: 771 - RNA, 19 nt, Homo sapiens
auggaaguuggggccaagc

SEQ ID NO: 772 - RNA, 19 nt, Homo sapiens
gcuuggccccaacuuccau

SEQ ID NO: 773 - RNA, 19 nt, Homo sapiens
uggaaguuggggccaagcc

SEQ ID NO: 774 - RNA, 19 nt, Homo sapiens
ggcuuggccccaacuucca

SEQ ID NO: 775 - RNA, 19 nt, Homo sapiens
ggaaguuggggccaagcca

SEQ ID NO: 776 - RNA, 19 nt, Homo sapiens
uggcuuggccccaacuucc

SEQ ID NO: 777 - RNA, 19 nt, Homo sapiens
gaaguuggggccaagccag

SEQ ID NO: 778 - RNA, 19 nt, Homo sapiens
cuggcuuggccccaacuuc

SEQ ID NO: 779 - RNA, 19 nt, Homo sapiens
aaguuggggccaagccagc

SEQ ID NO: 780 - RNA, 19 nt, Homo sapiens
gcuggcuuggccccaacuu

SEQ ID NO: 781 - RNA, 19 nt, Homo sapiens
aguuggggccaagccagcc

SEQ ID NO: 782 - RNA, 19 nt, Homo sapiens
ggcuggcuuggccccaacu

SEQ ID NO: 783 - RNA, 19 nt, Homo sapiens
guuggggccaagccagccc

SEQ ID NO: 784 - RNA, 19 nt, Homo sapiens
gggcuggcuuggccccaac

SEQ ID NO: 785 - RNA, 19 nt, Homo sapiens
uuggggccaagccagcccc

SEQ ID NO: 786 - RNA, 19 nt, Homo sapiens
ggggcuggcuuggccccaa

SEQ ID NO: 787 - RNA, 19 nt, Homo sapiens
uggggccaagccagccccu

SEQ ID NO: 788 - RNA, 19 nt, Homo sapiens
aggggcuggcuuggcccca

SEQ ID NO: 789 - RNA, 19 nt, Homo sapiens
ggggccaagccagccccuc

SEQ ID NO: 790 - RNA, 19 nt, Homo sapiens
gaggggcuggcuuggcccc

SEQ ID NO: 791 - RNA, 19 nt, Homo sapiens
gggccaagccagccccucg

SEQ ID NO: 792 - RNA, 19 nt, Homo sapiens
cgaggggcuggcuuggccc

SEQ ID NO: 793 - RNA, 19 nt, Homo sapiens
ggccaagccagccccucgg

SEQ ID NO: 794 - RNA, 19 nt, Homo sapiens
ccgaggggcuggcuuggcc

SEQ ID NO: 795 - RNA, 19 nt, Homo sapiens
gccaagccagccccucggg

SEQ ID NO: 796 - RNA, 19 nt, Homo sapiens
cccgaggggcuggcuuggc

SEQ ID NO: 797 - RNA, 19 nt, Homo sapiens
ccaagccagccccucgggc

SEQ ID NO: 798 - RNA, 19 nt, Homo sapiens
gcccgaggggcuggcuugg

SEQ ID NO: 799 - RNA, 19 nt, Homo sapiens
caagccagccccucgggca

SEQ ID NO: 800 - RNA, 19 nt, Homo sapiens
ugcccgaggggcuggcuug

SEQ ID NO: 801 - RNA, 19 nt, Homo sapiens
aagccagccccucgggcau

SEQ ID NO: 802 - RNA, 19 nt, Homo sapiens
augcccgaggggcuggcuu

SEQ ID NO: 803 - RNA, 19 nt, Homo sapiens
agccagccccucgggcauu

SEQ ID NO: 804 - RNA, 19 nt, Homo sapiens
aaugcccgaggggcuggcu

SEQ ID NO: 805 - RNA, 19 nt, Homo sapiens
gccagccccucgggcauug

SEQ ID NO: 806 - RNA, 19 nt, Homo sapiens
caaugcccgaggggcuggc

SEQ ID NO: 807 - RNA, 19 nt, Homo sapiens
ccagccccucgggcauugu

SEQ ID NO: 808 - RNA, 19 nt, Homo sapiens
acaaugcccgaggggcugg

SEQ ID NO: 809 - RNA, 19 nt, Homo sapiens
cagccccucgggcauuguc

SEQ ID NO: 810 - RNA, 19 nt, Homo sapiens
gacaaugcccgaggggcug

SEQ ID NO: 811 - RNA, 19 nt, Homo sapiens
agccccucgggcauugucc

SEQ ID NO: 812 - RNA, 19 nt, Homo sapiens
ggacaaugcccgaggggcu

SEQ ID NO: 813 - RNA, 19 nt, Homo sapiens
gccccucgggcauugucca

SEQ ID NO: 814 - RNA, 19 nt, Homo sapiens
uggacaaugcccgaggggc

SEQ ID NO: 815 - RNA, 19 nt, Homo sapiens
ccccucgggcauuguccac

SEQ ID NO: 816 - RNA, 19 nt, Homo sapiens
guggacaaugcccgagggg

SEQ ID NO: 817 - RNA, 19 nt, Homo sapiens
cccucgggcauuguccacu

SEQ ID NO: 818 - RNA, 19 nt, Homo sapiens
aguggacaaugcccgaggg

SEQ ID NO: 819 - RNA, 19 nt, Homo sapiens
ccucgggcauuguccacug

SEQ ID NO: 820 - RNA, 19 nt, Homo sapiens
caguggacaaugcccgagg

SEQ ID NO: 821 - RNA, 19 nt, Homo sapiens
cucgggcauuguccacugc

SEQ ID NO: 822 - RNA, 19 nt, Homo sapiens
gcaguggacaaugcccgag

SEQ ID NO: 823 - RNA, 19 nt, Homo sapiens
ucgggcauuguccacugca

SEQ ID NO: 824 - RNA, 19 nt, Homo sapiens
ugcaguggacaaugcccga

SEQ ID NO: 825 - RNA, 19 nt, Homo sapiens
cgggcauuguccacugcag

SEQ ID NO: 826 - RNA, 19 nt, Homo sapiens
cugcaguggacaaugcccg

SEQ ID NO: 827 - RNA, 19 nt, Homo sapiens
gggcauuguccacugcagc

SEQ ID NO: 828 - RNA, 19 nt, Homo sapiens
gcugcaguggacaaugccc

SEQ ID NO: 829 - RNA, 19 nt, Homo sapiens
ggcauuguccacugcagca

SEQ ID NO: 830 - RNA, 19 nt, Homo sapiens
ugcugcaguggacaaugcc

SEQ ID NO: 831 - RNA, 19 nt, Homo sapiens
gcauuguccacugcagcag

SEQ ID NO: 832 - RNA, 19 nt, Homo sapiens
cugcugcaguggacaaugc

SEQ ID NO: 833 - RNA, 19 nt, Homo sapiens
cauuguccacugcagcagu

SEQ ID NO: 834 - RNA, 19 nt, Homo sapiens
acugcugcaguggacaaug

SEQ ID NO: 835 - RNA, 19 nt, Homo sapiens
auuguccacugcagcagua

SEQ ID NO: 836 - RNA, 19 nt, Homo sapiens
uacugcugcaguggacaau

SEQ ID NO: 837 - RNA, 19 nt, Homo sapiens
uuguccacugcagcaguac

SEQ ID NO: 838 - RNA, 19 nt, Homo sapiens
guacugcugcaguggacaa

SEQ ID NO: 839 - RNA, 19 nt, Homo sapiens
uguccacugcagcaguaca

SEQ ID NO: 840 - RNA, 19 nt, Homo sapiens
uguacugcugcaguggaca

SEQ ID NO: 841 - RNA, 19 nt, Homo sapiens
guccacugcagcaguacac

SEQ ID NO: 842 - RNA, 19 nt, Homo sapiens
guguacugcugcaguggac

SEQ ID NO: 843 - RNA, 19 nt, Homo sapiens
uccacugcagcaguacacu

SEQ ID NO: 844 - RNA, 19 nt, Homo sapiens
aguguacugcugcagugga

SEQ ID NO: 845 - RNA, 19 nt, Homo sapiens
ccacugcagcaguacacua

SEQ ID NO: 846 - RNA, 19 nt, Homo sapiens
uaguguacugcugcagugg

SEQ ID NO: 847 - RNA, 19 nt, Homo sapiens
cacugcagcaguacacuac

SEQ ID NO: 848 - RNA, 19 nt, Homo sapiens
guaguguacugcugcagug

SEQ ID NO: 849 - RNA, 19 nt, Homo sapiens
acugcagcaguacacuacc

SEQ ID NO: 850 - RNA, 19 nt, Homo sapiens
gguaguguacugcugcagu

SEQ ID NO: 851 - RNA, 19 nt, Homo sapiens
cugcagcaguacacuacca

SEQ ID NO: 852 - RNA, 19 nt, Homo sapiens
ugguaguguacugcugcag

SEQ ID NO: 853 - RNA, 19 nt, Homo sapiens
ugcagcaguacacuaccaa

SEQ ID NO: 854 - RNA, 19 nt, Homo sapiens
uugguaguguacugcugca

SEQ ID NO: 855 - RNA, 19 nt, Homo sapiens
gcagcaguacacuaccaac

SEQ ID NO: 856 - RNA, 19 nt, Homo sapiens
guugguaguguacugcugc

SEQ ID NO: 857 - RNA, 19 nt, Homo sapiens
agcaguacacuaccaacag

SEQ ID NO: 858 - RNA, 19 nt, Homo sapiens
cuguugguaguguacugcu

SEQ ID NO: 859 - RNA, 19 nt, Homo sapiens
gcaguacacuaccaacaga

SEQ ID NO: 860 - RNA, 19 nt, Homo sapiens
ucuguugguaguguacugc

SEQ ID NO: 861 - RNA, 19 nt, Homo sapiens
caguacacuaccaacagau

SEQ ID NO: 862 - RNA, 19 nt, Homo sapiens
aucuguugguaguguacug

SEQ ID NO: 863 - RNA, 19 nt, Homo sapiens
aguacacuaccaacagauc

SEQ ID NO: 864 - RNA, 19 nt, Homo sapiens
gaucuguugguaguguacu

SEQ ID NO: 865 - RNA, 19 nt, Homo sapiens
guacacuaccaacagauca

SEQ ID NO: 866 - RNA, 19 nt, Homo sapiens
ugaucuguugguaguguac

SEQ ID NO: 867 - RNA, 19 nt, Homo sapiens
uacacuaccaacagaucaa

SEQ ID NO: 868 - RNA, 19 nt, Homo sapiens
uugaucuguugguagugua

SEQ ID NO: 869 - RNA, 19 nt, Homo sapiens
acacuaccaacagaucaaa

SEQ ID NO: 870 - RNA, 19 nt, Homo sapiens
uuugaucuguugguagugu

SEQ ID NO: 871 - RNA, 19 nt, Homo sapiens
cacuaccaacagaucaaag

SEQ ID NO: 872 - RNA, 19 nt, Homo sapiens
cuuugaucuguugguagug

SEQ ID NO: 873 - RNA, 19 nt, Homo sapiens
acuaccaacagaucaaaga

SEQ ID NO: 874 - RNA, 19 nt, Homo sapiens
ucuuugaucuguugguagu

SEQ ID NO: 875 - RNA, 19 nt, Homo sapiens
cuaccaacagaucaaagaa

SEQ ID NO: 876 - RNA, 19 nt, Homo sapiens
uucuuugaucuguugguag

SEQ ID NO: 877 - RNA, 19 nt, Homo sapiens
uaccaacagaucaaagaaa

SEQ ID NO: 878 - RNA, 19 nt, Homo sapiens
uuucuuugaucuguuggua

SEQ ID NO: 879 - RNA, 19 nt, Homo sapiens
accaacagaucaaagaaac

SEQ ID NO: 880 - RNA, 19 nt, Homo sapiens
guuucuuugaucuguuggu

SEQ ID NO: 881 - RNA, 19 nt, Homo sapiens
ccaacagaucaaagaaacc

SEQ ID NO: 882 - RNA, 19 nt, Homo sapiens
gguuucuuugaucuguugg

SEQ ID NO: 883 - RNA, 19 nt, Homo sapiens
uccggccagugagaaagac

SEQ ID NO: 884 - RNA, 19 nt, Homo sapiens
gucuuucucacuggccgga

SEQ ID NO: 885 - RNA, 19 nt, Homo sapiens
ccggccagugagaaagaca

SEQ ID NO: 886 - RNA, 19 nt, Homo sapiens
ugucuuucucacuggccgg

SEQ ID NO: 887 - RNA, 19 nt, Homo sapiens
cggccagugagaaagacaa

SEQ ID NO: 888 - RNA, 19 nt, Homo sapiens
uugucuuucucacuggccg

SEQ ID NO: 889 - RNA, 19 nt, Homo sapiens
ggccagugagaaagacaaa

SEQ ID NO: 890 - RNA, 19 nt, Homo sapiens
uuugucuuucucacuggcc

SEQ ID NO: 891 - RNA, 19 nt, Homo sapiens
gccagugagaaagacaaaa

SEQ ID NO: 892 - RNA, 19 nt, Homo sapiens
uuuugucuuucucacuggc

SEQ ID NO: 893 - RNA, 19 nt, Homo sapiens
ccagugagaaagacaaaac

SEQ ID NO: 894 - RNA, 19 nt, Homo sapiens
guuuugucuuucucacugg

SEQ ID NO: 895 - RNA, 19 nt, Homo sapiens
cagugagaaagacaaaacu

SEQ ID NO: 896 - RNA, 19 nt, Homo sapiens
aguuuugucuuucucacug

SEQ ID NO: 897 - RNA, 19 nt, Homo sapiens
agugagaaagacaaaacug

SEQ ID NO: 898 - RNA, 19 nt, Homo sapiens
caguuuugucuuucucacu

SEQ ID NO: 899 - RNA, 19 nt, Homo sapiens
gugagaaagacaaaacugc

SEQ ID NO: 900 - RNA, 19 nt, Homo sapiens
gcaguuuugucuuucucac

SEQ ID NO: 901 - RNA, 19 nt, Homo sapiens
cuccugauggaucccagca

SEQ ID NO: 902 - RNA, 19 nt, Homo sapiens
ugcugggauccaucaggag

SEQ ID NO: 903 - RNA, 19 nt, Homo sapiens
uccugauggaucccagcag

SEQ ID NO: 904 - RNA, 19 nt, Homo sapiens
cugcugggauccaucagga

SEQ ID NO: 905 - RNA, 19 nt, Homo sapiens
ccugauggaucccagcaga

SEQ ID NO: 906 - RNA, 19 nt, Homo sapiens
ucugcugggauccaucagg

SEQ ID NO: 907 - RNA, 19 nt, Homo sapiens
cugauggaucccagcagag

SEQ ID NO: 908 - RNA, 19 nt, Homo sapiens
cucugcugggauccaucag

SEQ ID NO: 909 - RNA, 19 nt, Homo sapiens
ugauggaucccagcagagu

SEQ ID NO: 910 - RNA, 19 nt, Homo sapiens
acucugcugggauccauca

SEQ ID NO: 911 - RNA, 19 nt, Homo sapiens
gauggaucccagcagaguc

SEQ ID NO: 912 - RNA, 19 nt, Homo sapiens
gacucugcugggauccauc

SEQ ID NO: 913 - RNA, 19 nt, Homo sapiens
auggaucccagcagagucc

SEQ ID NO: 914 - RNA, 19 nt, Homo sapiens
ggacucugcugggauccau

SEQ ID NO: 915 - RNA, 19 nt, Homo sapiens
uggaucccagcagagucca

SEQ ID NO: 916 - RNA, 19 nt, Homo sapiens
uggacucugcugggaucca

SEQ ID NO: 917 - RNA, 19 nt, Homo sapiens
ggaucccagcagaguccag

SEQ ID NO: 918 - RNA, 19 nt, Homo sapiens
cuggacucugcugggaucc

SEQ ID NO: 919 - RNA, 19 nt, Homo sapiens
gaucccagcagaguccaga

SEQ ID NO: 920 - RNA, 19 nt, Homo sapiens
ucuggacucugcugggauc

SEQ ID NO: 921 - RNA, 19 nt, Homo sapiens
aucccagcagaguccagau

SEQ ID NO: 922 - RNA, 19 nt, Homo sapiens
aucuggacucugcugggau

SEQ ID NO: 923 - RNA, 19 nt, Homo sapiens
ucccagcagaguccagaug

SEQ ID NO: 924 - RNA, 19 nt, Homo sapiens
caucuggacucugcuggga

SEQ ID NO: 925 - RNA, 19 nt, Homo sapiens
cccagcagaguccagaugg

SEQ ID NO: 926 - RNA, 19 nt, Homo sapiens
ccaucuggacucugcuggg

SEQ ID NO: 927 - RNA, 19 nt, Homo sapiens
ccagcagaguccagauggc

SEQ ID NO: 928 - RNA, 19 nt, Homo sapiens
gccaucuggacucugcugg

SEQ ID NO: 929 - RNA, 19 nt, Homo sapiens
cagcagaguccagauggca

SEQ ID NO: 930 - RNA, 19 nt, Homo sapiens
ugccaucuggacucugcug

SEQ ID NO: 931 - RNA, 19 nt, Homo sapiens
agcagaguccagauggcac

SEQ ID NO: 932 - RNA, 19 nt, Homo sapiens
gugccaucuggacucugcu

SEQ ID NO: 933 - RNA, 19 nt, Homo sapiens
gcagaguccagauggcaca

SEQ ID NO: 934 - RNA, 19 nt, Homo sapiens
ugugccaucuggacucugc

SEQ ID NO: 935 - RNA, 19 nt, Homo sapiens
cagaguccagauggcacac

SEQ ID NO: 936 - RNA, 19 nt, Homo sapiens
gugugccaucuggacucug

SEQ ID NO: 937 - RNA, 19 nt, Homo sapiens
agaguccagauggcacaca

SEQ ID NO: 938 - RNA, 19 nt, Homo sapiens
ugugugccaucuggacucu

SEQ ID NO: 939 - RNA, 19 nt, Homo sapiens
gaguccagauggcacacag

SEQ ID NO: 940 - RNA, 19 nt, Homo sapiens
cugugugccaucuggacuc

SEQ ID NO: 941 - RNA, 19 nt, Homo sapiens
aguccagauggcacacagc

SEQ ID NO: 942 - RNA, 19 nt, Homo sapiens
gcugugugccaucuggacu

SEQ ID NO: 943 - RNA, 19 nt, Homo sapiens
guccagauggcacacagcu

SEQ ID NO: 944 - RNA, 19 nt, Homo sapiens
agcugugugccaucuggac

SEQ ID NO: 945 - RNA, 19 nt, Homo sapiens
uccagauggcacacagcuu

SEQ ID NO: 946 - RNA, 19 nt, Homo sapiens
aagcugugugccaucugga

SEQ ID NO: 947 - RNA, 19 nt, Homo sapiens
ccagauggcacacagcuuc

SEQ ID NO: 948 - RNA, 19 nt, Homo sapiens
gaagcugugugccaucugg

SEQ ID NO: 949 - RNA, 19 nt, Homo sapiens
cagauggcacacagcuucc

SEQ ID NO: 950 - RNA, 19 nt, Homo sapiens
ggaagcugugugccaucug

SEQ ID NO: 951 - RNA, 19 nt, Homo sapiens
agauggcacacagcuuccg

SEQ ID NO: 952 - RNA, 19 nt, Homo sapiens
cggaagcugugugccaucu

SEQ ID NO: 953 - RNA, 19 nt, Homo sapiens
gauggcacacagcuuccgu

SEQ ID NO: 954 - RNA, 19 nt, Homo sapiens
acggaagcugugugccauc

SEQ ID NO: 955 - RNA, 19 nt, Homo sapiens
auggcacacagcuuccguc

SEQ ID NO: 956 - RNA, 19 nt, Homo sapiens
gacggaagcugugugccau

SEQ ID NO: 957 - RNA, 19 nt, Homo sapiens
uggcacacagcuuccgucu

SEQ ID NO: 958 - RNA, 19 nt, Homo sapiens
agacggaagcugugugcca

SEQ ID NO: 959 - RNA, 19 nt, Homo sapiens
ggcacacagcuuccgucug

SEQ ID NO: 960 - RNA, 19 nt, Homo sapiens
cagacggaagcugugugcc

SEQ ID NO: 961 - RNA, 19 nt, Homo sapiens
gcacacagcuuccgucugg

SEQ ID NO: 962 - RNA, 19 nt, Homo sapiens
ccagacggaagcugugugc

SEQ ID NO: 963 - RNA, 19 nt, Homo sapiens
cacacagcuuccgucugga

SEQ ID NO: 964 - RNA, 19 nt, Homo sapiens
uccagacggaagcugugug

SEQ ID NO: 965 - RNA, 19 nt, Homo sapiens
acacagcuuccgucuggac

SEQ ID NO: 966 - RNA, 19 nt, Homo sapiens
guccagacggaagcugugu

SEQ ID NO: 967 - RNA, 19 nt, Homo sapiens
cacagcuuccgucuggaca

SEQ ID NO: 968 - RNA, 19 nt, Homo sapiens
uguccagacggaagcugug

SEQ ID NO: 969 - RNA, 19 nt, Homo sapiens
acagcuuccgucuggacac

SEQ ID NO: 970 - RNA, 19 nt, Homo sapiens
guguccagacggaagcugu

SEQ ID NO: 971 - RNA, 19 nt, Homo sapiens
cagcuuccgucuggacacc

SEQ ID NO: 972 - RNA, 19 nt, Homo sapiens
gguguccagacggaagcug

SEQ ID NO: 973 - RNA, 19 nt, Homo sapiens
agcuuccgucuggacaccc

SEQ ID NO: 974 - RNA, 19 nt, Homo sapiens
ggguguccagacggaagcu

SEQ ID NO: 975 - RNA, 19 nt, Homo sapiens
gcuuccgucuggacacccc

SEQ ID NO: 976 - RNA, 19 nt, Homo sapiens
gggguguccagacggaagc

SEQ ID NO: 977 - RNA, 19 nt, Homo sapiens
cuuccgucuggacaccccu

SEQ ID NO: 978 - RNA, 19 nt, Homo sapiens
agggguguccagacggaag

SEQ ID NO: 979 - RNA, 19 nt, Homo sapiens
uuccgucuggacaccccuu

SEQ ID NO: 980 - RNA, 19 nt, Homo sapiens
aagggguguccagacggaa

SEQ ID NO: 981 - RNA, 19 nt, Homo sapiens
uccgucuggacaccccuug

SEQ ID NO: 982 - RNA, 19 nt, Homo sapiens
caagggguguccagacgga

SEQ ID NO: 983 - RNA, 19 nt, Homo sapiens
ccgucuggacaccccuugc

SEQ ID NO: 984 - RNA, 19 nt, Homo sapiens
gcaagggguguccagacgg

SEQ ID NO: 985 - RNA, 19 nt, Homo sapiens
cgucuggacaccccuugcc

SEQ ID NO: 986 - RNA, 19 nt, Homo sapiens
ggcaagggguguccagacg

SEQ ID NO: 987 - RNA, 19 nt, Homo sapiens
gucuggacaccccuugccu

SEQ ID NO: 988 - RNA, 19 nt, Homo sapiens
aggcaagggguguccagac

SEQ ID NO: 989 - RNA, 19 nt, Homo sapiens
ucuggacaccccuugccug

SEQ ID NO: 990 - RNA, 19 nt, Homo sapiens
caggcaagggguguccaga

SEQ ID NO: 991 - RNA, 19 nt, Homo sapiens
cuggacaccccuugccugc

SEQ ID NO: 992 - RNA, 19 nt, Homo sapiens
gcaggcaagggguguccag

SEQ ID NO: 993 - RNA, 19 nt, Homo sapiens
uggacaccccuugccugcc

SEQ ID NO: 994 - RNA, 19 nt, Homo sapiens
ggcaggcaaggggugucca

SEQ ID NO: 995 - RNA, 19 nt, Homo sapiens
ggacaccccuugccugcca

SEQ ID NO: 996 - RNA, 19 nt, Homo sapiens
uggcaggcaaggggugucc

SEQ ID NO: 997 - RNA, 19 nt, Homo sapiens
gacaccccuugccugccac

SEQ ID NO: 998 - RNA, 19 nt, Homo sapiens
guggcaggcaagggguguc

SEQ ID NO: 999 - RNA, 19 nt, Homo sapiens
acaccccuugccugccaca

SEQ ID NO: 1000 - RNA, 19 nt, Homo sapiens
uguggcaggcaaggggugu

SEQ ID NO: 1001 - RNA, 19 nt, Homo sapiens
caccccuugccugccacaa

SEQ ID NO: 1002 - RNA, 19 nt, Homo sapiens
uuguggcaggcaaggggug

SEQ ID NO: 1003 - RNA, 19 nt, Homo sapiens
accccuugccugccacaag

SEQ ID NO: 1004 - RNA, 19 nt, Homo sapiens
cuuguggcaggcaaggggu

SEQ ID NO: 1005 - RNA, 19 nt, Homo sapiens
ccccuugccugccacaagc

SEQ ID NO: 1006 - RNA, 19 nt, Homo sapiens
gcuuguggcaggcaagggg

SEQ ID NO: 1007 - RNA, 19 nt, Homo sapiens
cccuugccugccacaagcc

SEQ ID NO: 1008 - RNA, 19 nt, Homo sapiens
ggcuuguggcaggcaaggg

SEQ ID NO: 1009 - RNA, 19 nt, Homo sapiens
ccuugccugccacaagcca

SEQ ID NO: 1010 - RNA, 19 nt, Homo sapiens
uggcuuguggcaggcaagg

SEQ ID NO: 1011 - RNA, 19 nt, Homo sapiens
cuugccugccacaagccag

SEQ ID NO: 1012 - RNA, 19 nt, Homo sapiens
cuggcuuguggcaggcaag

SEQ ID NO: 1013 - RNA, 19 nt, Homo sapiens
uugccugccacaagccagg

SEQ ID NO: 1014 - RNA, 19 nt, Homo sapiens
ccuggcuuguggcaggcaa

SEQ ID NO: 1015 - RNA, 19 nt, Homo sapiens
ugccugccacaagccaggg

SEQ ID NO: 1016 - RNA, 19 nt, Homo sapiens
cccuggcuuguggcaggca

SEQ ID NO: 1017 - RNA, 19 nt, Homo sapiens
gccugccacaagccagggc

SEQ ID NO: 1018 - RNA, 19 nt, Homo sapiens
gcccuggcuuguggcaggc

SEQ ID NO: 1019 - RNA, 19 nt, Homo sapiens
ccugccacaagccagggca

SEQ ID NO: 1020 - RNA, 19 nt, Homo sapiens
ugcccuggcuuguggcagg

SEQ ID NO: 1021 - RNA, 19 nt, Homo sapiens
cugccacaagccagggcac

SEQ ID NO: 1022 - RNA, 19 nt, Homo sapiens
gugcccuggcuuguggcag

SEQ ID NO: 1023 - RNA, 19 nt, Homo sapiens
ugccacaagccagggcacu

SEQ ID NO: 1024 - RNA, 19 nt, Homo sapiens
agugcccuggcuuguggca

SEQ ID NO: 1025 - RNA, 19 nt, Homo sapiens
gccacaagccagggcacug

SEQ ID NO: 1026 - RNA, 19 nt, Homo sapiens
cagugcccuggcuuguggc

SEQ ID NO: 1027 - RNA, 19 nt, Homo sapiens
ccacaagccagggcacugc

SEQ ID NO: 1028 - RNA, 19 nt, Homo sapiens
gcagugcccuggcuugugg

SEQ ID NO: 1029 - RNA, 19 nt, Homo sapiens
cacaagccagggcacugca

SEQ ID NO: 1030 - RNA, 19 nt, Homo sapiens
ugcagugcccuggcuugug

SEQ ID NO: 1031 - RNA, 19 nt, Homo sapiens
acaagccagggcacugcaa

SEQ ID NO: 1032 - RNA, 19 nt, Homo sapiens
uugcagugcccuggcuugu

SEQ ID NO: 1033 - RNA, 19 nt, Homo sapiens
caagccagggcacugcaag

SEQ ID NO: 1034 - RNA, 19 nt, Homo sapiens
cuugcagugcccuggcuug

SEQ ID NO: 1035 - RNA, 19 nt, Homo sapiens
aagccagggcacugcaagc

SEQ ID NO: 1036 - RNA, 19 nt, Homo sapiens
gcuugcagugcccuggcuu

SEQ ID NO: 1037 - RNA, 19 nt, Homo sapiens
agccagggcacugcaagca

SEQ ID NO: 1038 - RNA, 19 nt, Homo sapiens
ugcuugcagugcccuggcu

SEQ ID NO: 1039 - RNA, 19 nt, Homo sapiens
gccagggcacugcaagcaa

SEQ ID NO: 1040 - RNA, 19 nt, Homo sapiens
uugcuugcagugcccuggc

SEQ ID NO: 1041 - RNA, 19 nt, Homo sapiens
ccagggcacugcaagcaaa

SEQ ID NO: 1042 - RNA, 19 nt, Homo sapiens
uuugcuugcagugcccugg

SEQ ID NO: 1043 - RNA, 19 nt, Homo sapiens
cagggcacugcaagcaaau

SEQ ID NO: 1044 - RNA, 19 nt, Homo sapiens
auuugcuugcagugcccug

SEQ ID NO: 1045 - RNA, 19 nt, Homo sapiens
agggcacugcaagcaaaug

SEQ ID NO: 1046 - RNA, 19 nt, Homo sapiens
cauuugcuugcagugcccu

SEQ ID NO: 1047 - RNA, 19 nt, Homo sapiens
gggcacugcaagcaaaugc

SEQ ID NO: 1048 - RNA, 19 nt, Homo sapiens
gcauuugcuugcagugccc

SEQ ID NO: 1049 - RNA, 19 nt, Homo sapiens
ggcacugcaagcaaaugcc

SEQ ID NO: 1050 - RNA, 19 nt, Homo sapiens
ggcauuugcuugcagugcc

SEQ ID NO: 1051 - RNA, 19 nt, Homo sapiens
gcacugcaagcaaaugccc

SEQ ID NO: 1052 - RNA, 19 nt, Homo sapiens
gggcauuugcuugcagugc

SEQ ID NO: 1053 - RNA, 19 nt, Homo sapiens
acugcaagcaaaugcccuu

SEQ ID NO: 1054 - RNA, 19 nt, Homo sapiens
aagggcauuugcuugcagu

SEQ ID NO: 1055 - RNA, 19 nt, Homo sapiens
cugcaagcaaaugcccuuu

SEQ ID NO: 1056 - RNA, 19 nt, Homo sapiens
aaagggcauuugcuugcag

SEQ ID NO: 1057 - RNA, 19 nt, Homo sapiens
ugcaagcaaaugcccuuuc

SEQ ID NO: 1058 - RNA, 19 nt, Homo sapiens
gaaagggcauuugcuugca

SEQ ID NO: 1059 - RNA, 19 nt, Homo sapiens
gcaagcaaaugcccuuucc

SEQ ID NO: 1060 - RNA, 19 nt, Homo sapiens
ggaaagggcauuugcuugc

SEQ ID NO: 1061 - RNA, 19 nt, Homo sapiens
caagcaaaugcccuuuccu

SEQ ID NO: 1062 - RNA, 19 nt, Homo sapiens
aggaaagggcauuugcuug

SEQ ID NO: 1063 - RNA, 19 nt, Homo sapiens
aagcaaaugcccuuuccug

SEQ ID NO: 1064 - RNA, 19 nt, Homo sapiens
caggaaagggcauuugcuu

SEQ ID NO: 1065 - RNA, 19 nt, Homo sapiens
agcaaaugcccuuuccugg

SEQ ID NO: 1066 - RNA, 19 nt, Homo sapiens
ccaggaaagggcauuugcu

SEQ ID NO: 1067 - RNA, 19 nt, Homo sapiens
gcaaaugcccuuuccuggc

SEQ ID NO: 1068 - RNA, 19 nt, Homo sapiens
gccaggaaagggcauuugc

SEQ ID NO: 1069 - RNA, 19 nt, Homo sapiens
caaaugcccuuuccuggca

SEQ ID NO: 1070 - RNA, 19 nt, Homo sapiens
ugccaggaaagggcauuug

SEQ ID NO: 1071 - RNA, 19 nt, Homo sapiens
aaaugcccuuuccuggcag

SEQ ID NO: 1072 - RNA, 19 nt, Homo sapiens
cugccaggaaagggcauuu

SEQ ID NO: 1073 - RNA, 19 nt, Homo sapiens
aaugcccuuuccuggcagc

SEQ ID NO: 1074 - RNA, 19 nt, Homo sapiens
gcugccaggaaagggcauu

SEQ ID NO: 1075 - RNA, 19 nt, Homo sapiens
augcccuuuccuggcagca

SEQ ID NO: 1076 - RNA, 19 nt, Homo sapiens
ugcugccaggaaagggcau

SEQ ID NO: 1077 - RNA, 19 nt, Homo sapiens
ugcccuuuccuggcagcac

SEQ ID NO: 1078 - RNA, 19 nt, Homo sapiens
gugcugccaggaaagggca

SEQ ID NO: 1079 - RNA, 19 nt, Homo sapiens
gcccuuuccuggcagcaca

SEQ ID NO: 1080 - RNA, 19 nt, Homo sapiens
ugugcugccaggaaagggc

SEQ ID NO: 1081 - RNA, 19 nt, Homo sapiens
cccuuuccuggcagcacag

SEQ ID NO: 1082 - RNA, 19 nt, Homo sapiens
cugugcugccaggaaaggg

SEQ ID NO: 1083 - RNA, 19 nt, Homo sapiens
ccuuuccuggcagcacaga

SEQ ID NO: 1084 - RNA, 19 nt, Homo sapiens
ucugugcugccaggaaagg

SEQ ID NO: 1085 - RNA, 19 nt, Homo sapiens
cuuuccuggcagcacagau

SEQ ID NO: 1086 - RNA, 19 nt, Homo sapiens
aucugugcugccaggaaag

SEQ ID NO: 1087 - RNA, 19 nt, Homo sapiens
uuuccuggcagcacagaug

SEQ ID NO: 1088 - RNA, 19 nt, Homo sapiens
caucugugcugccaggaaa

SEQ ID NO: 1089 - RNA, 19 nt, Homo sapiens
uuccuggcagcacagauga

SEQ ID NO: 1090 - RNA, 19 nt, Homo sapiens
ucaucugugcugccaggaa

SEQ ID NO: 1091 - RNA, 19 nt, Homo sapiens
uccuggcagcacagaugaa

SEQ ID NO: 1092 - RNA, 19 nt, Homo sapiens
uucaucugugcugccagga

SEQ ID NO: 1093 - RNA, 19 nt, Homo sapiens
ccuggcagcacagaugaau

SEQ ID NO: 1094 - RNA, 19 nt, Homo sapiens
auucaucugugcugccagg

SEQ ID NO: 1095 - RNA, 19 nt, Homo sapiens
cuggcagcacagaugaauc

SEQ ID NO: 1096 - RNA, 19 nt, Homo sapiens
gauucaucugugcugccag

SEQ ID NO: 1097 - RNA, 19 nt, Homo sapiens
ggcagcacagaugaaucag

SEQ ID NO: 1098 - RNA, 19 nt, Homo sapiens
cugauucaucugugcugcc

SEQ ID NO: 1099 - RNA, 19 nt, Homo sapiens
cagcacagaugaaucagag

SEQ ID NO: 1100 - RNA, 19 nt, Homo sapiens
cucugauucaucugugcug

SEQ ID NO: 1101 - RNA, 19 nt, Homo sapiens
ggcagcagugucuucugca

SEQ ID NO: 1102 - RNA, 19 nt, Homo sapiens
ugcagaagacacugcugcc

SEQ ID NO: 1103 - RNA, 19 nt, Homo sapiens
gcagcagugucuucugcaa

SEQ ID NO: 1104 - RNA, 19 nt, Homo sapiens
uugcagaagacacugcugc

SEQ ID NO: 1105 - RNA, 19 nt, Homo sapiens
cagcagugucuucugcaaa

SEQ ID NO: 1106 - RNA, 19 nt, Homo sapiens
uuugcagaagacacugcug

SEQ ID NO: 1107 - RNA, 19 nt, Homo sapiens
agcagugucuucugcaaag

SEQ ID NO: 1108 - RNA, 19 nt, Homo sapiens
cuuugcagaagacacugcu

SEQ ID NO: 1109 - RNA, 19 nt, Homo sapiens
gcagugucuucugcaaagc

SEQ ID NO: 1110 - RNA, 19 nt, Homo sapiens
gcuuugcagaagacacugc

SEQ ID NO: 1111 - RNA, 19 nt, Homo sapiens
cagugucuucugcaaagcc

SEQ ID NO: 1112 - RNA, 19 nt, Homo sapiens
ggcuuugcagaagacacug

SEQ ID NO: 1113 - RNA, 19 nt, Homo sapiens
agugucuucugcaaagcca

SEQ ID NO: 1114 - RNA, 19 nt, Homo sapiens
uggcuuugcagaagacacu

SEQ ID NO: 1115 - RNA, 19 nt, Homo sapiens
gugucuucugcaaagccag

SEQ ID NO: 1116 - RNA, 19 nt, Homo sapiens
cuggcuuugcagaagacac

SEQ ID NO: 1117 - RNA, 19 nt, Homo sapiens
ugucuucugcaaagccagu

SEQ ID NO: 1118 - RNA, 19 nt, Homo sapiens
acuggcuuugcagaagaca

SEQ ID NO: 1119 - RNA, 19 nt, Homo sapiens
gucuucugcaaagccaguc

SEQ ID NO: 1120 - RNA, 19 nt, Homo sapiens
gacuggcuuugcagaagac

SEQ ID NO: 1121 - RNA, 19 nt, Homo sapiens
ucuucugcaaagccagucu

SEQ ID NO: 1122 - RNA, 19 nt, Homo sapiens
agacuggcuuugcagaaga

SEQ ID NO: 1123 - RNA, 19 nt, Homo sapiens
cuucugcaaagccagucuu

SEQ ID NO: 1124 - RNA, 19 nt, Homo sapiens
aagacuggcuuugcagaag

SEQ ID NO: 1125 - RNA, 19 nt, Homo sapiens
uucugcaaagccagucuug

SEQ ID NO: 1126 - RNA, 19 nt, Homo sapiens
caagacuggcuuugcagaa

SEQ ID NO: 1127 - RNA, 19 nt, Homo sapiens
ucugcaaagccagucuuga

SEQ ID NO: 1128 - RNA, 19 nt, Homo sapiens
ucaagacuggcuuugcaga

SEQ ID NO: 1129 - RNA, 19 nt, Homo sapiens
cugcaaagccagucuugag

SEQ ID NO: 1130 - RNA, 19 nt, Homo sapiens
cucaagacuggcuuugcag

SEQ ID NO: 1131 - RNA, 19 nt, Homo sapiens
ugcaaagccagucuugagc

SEQ ID NO: 1132 - RNA, 19 nt, Homo sapiens
gcucaagacuggcuuugca

SEQ ID NO: 1133 - RNA, 19 nt, Homo sapiens
gcaaagccagucuugagcu

SEQ ID NO: 1134 - RNA, 19 nt, Homo sapiens
agcucaagacuggcuuugc

SEQ ID NO: 1135 - RNA, 19 nt, Homo sapiens
caaagccagucuugagcuu

SEQ ID NO: 1136 - RNA, 19 nt, Homo sapiens
aagcucaagacuggcuuug

SEQ ID NO: 1137 - RNA, 19 nt, Homo sapiens
aaagccagucuugagcuuc

SEQ ID NO: 1138 - RNA, 19 nt, Homo sapiens
gaagcucaagacuggcuuu

SEQ ID NO: 1139 - RNA, 19 nt, Homo sapiens
aagccagucuugagcuuca

SEQ ID NO: 1140 - RNA, 19 nt, Homo sapiens
ugaagcucaagacuggcuu

SEQ ID NO: 1141 - RNA, 19 nt, Homo sapiens
agccagucuugagcuucag

SEQ ID NO: 1142 - RNA, 19 nt, Homo sapiens
cugaagcucaagacuggcu

SEQ ID NO: 1143 - RNA, 19 nt, Homo sapiens
gccagucuugagcuucagg

SEQ ID NO: 1144 - RNA, 19 nt, Homo sapiens
ccugaagcucaagacuggc

SEQ ID NO: 1145 - RNA, 19 nt, Homo sapiens
ccagucuugagcuucagga

SEQ ID NO: 1146 - RNA, 19 nt, Homo sapiens
uccugaagcucaagacugg

SEQ ID NO: 1147 - RNA, 19 nt, Homo sapiens
cagucuugagcuucaggag

SEQ ID NO: 1148 - RNA, 19 nt, Homo sapiens
cuccugaagcucaagacug

SEQ ID NO: 1149 - RNA, 19 nt, Homo sapiens
agucuugagcuucaggagg

SEQ ID NO: 1150 - RNA, 19 nt, Homo sapiens
ccuccugaagcucaagacu

SEQ ID NO: 1151 - RNA, 19 nt, Homo sapiens
gucuugagcuucaggagga

SEQ ID NO: 1152 - RNA, 19 nt, Homo sapiens
uccuccugaagcucaagac

SEQ ID NO: 1153 - RNA, 19 nt, Homo sapiens
ucuugagcuucaggaggau

SEQ ID NO: 1154 - RNA, 19 nt, Homo sapiens
auccuccugaagcucaaga

SEQ ID NO: 1155 - RNA, 19 nt, Homo sapiens
cuugagcuucaggaggaug

SEQ ID NO: 1156 - RNA, 19 nt, Homo sapiens
cauccuccugaagcucaag

SEQ ID NO: 1157 - RNA, 19 nt, Homo sapiens
uugagcuucaggaggaugu

SEQ ID NO: 1158 - RNA, 19 nt, Homo sapiens
acauccuccugaagcucaa

SEQ ID NO: 1159 - RNA, 19 nt, Homo sapiens
ugagcuucaggaggaugug

SEQ ID NO: 1160 - RNA, 19 nt, Homo sapiens
cacauccuccugaagcuca

SEQ ID NO: 1161 - RNA, 19 nt, Homo sapiens
gagcuucaggaggaugugc

SEQ ID NO: 1162 - RNA, 19 nt, Homo sapiens
gcacauccuccugaagcuc

SEQ ID NO: 1163 - RNA, 19 nt, Homo sapiens
agcuucaggaggaugugca

SEQ ID NO: 1164 - RNA, 19 nt, Homo sapiens
ugcacauccuccugaagcu

SEQ ID NO: 1165 - RNA, 19 nt, Homo sapiens
gcuucaggaggaugugcag

SEQ ID NO: 1166 - RNA, 19 nt, Homo sapiens
cugcacauccuccugaagc

SEQ ID NO: 1167 - RNA, 19 nt, Homo sapiens
cuucaggaggaugugcagg

SEQ ID NO: 1168 - RNA, 19 nt, Homo sapiens
ccugcacauccuccugaag

SEQ ID NO: 1169 - RNA, 19 nt, Homo sapiens
uucaggaggaugugcagga

SEQ ID NO: 1170 - RNA, 19 nt, Homo sapiens
uccugcacauccuccugaa

SEQ ID NO: 1171 - RNA, 19 nt, Homo sapiens
ucaggaggaugugcaggaa

SEQ ID NO: 1172 - RNA, 19 nt, Homo sapiens
uuccugcacauccuccuga

SEQ ID NO: 1173 - RNA, 19 nt, Homo sapiens
caggaggaugugcaggaaa

SEQ ID NO: 1174 - RNA, 19 nt, Homo sapiens
uuuccugcacauccuccug

SEQ ID NO: 1175 - RNA, 19 nt, Homo sapiens
aggaggaugugcaggaaau

SEQ ID NO: 1176 - RNA, 19 nt, Homo sapiens
auuuccugcacauccuccu

SEQ ID NO: 1177 - RNA, 19 nt, Homo sapiens
ggaggaugugcaggaaaug

SEQ ID NO: 1178 - RNA, 19 nt, Homo sapiens
cauuuccugcacauccucc

SEQ ID NO: 1179 - RNA, 19 nt, Homo sapiens
gaggaugugcaggaaauga

SEQ ID NO: 1180 - RNA, 19 nt, Homo sapiens
ucauuuccugcacauccuc

SEQ ID NO: 1181 - RNA, 19 nt, Homo sapiens
aggaugugcaggaaaugaa

SEQ ID NO: 1182 - RNA, 19 nt, Homo sapiens
uucauuuccugcacauccu

SEQ ID NO: 1183 - RNA, 19 nt, Homo sapiens
ggaugugcaggaaaugaau

SEQ ID NO: 1184 - RNA, 19 nt, Homo sapiens
auucauuuccugcacaucc

SEQ ID NO: 1185 - RNA, 19 nt, Homo sapiens
gaugugcaggaaaugaaug

SEQ ID NO: 1186 - RNA, 19 nt, Homo sapiens
cauucauuuccugcacauc

SEQ ID NO: 1187 - RNA, 19 nt, Homo sapiens
augugcaggaaaugaaugc

SEQ ID NO: 1188 - RNA, 19 nt, Homo sapiens
gcauucauuuccugcacau

SEQ ID NO: 1189 - RNA, 19 nt, Homo sapiens
gugaggaaagagguugcug

SEQ ID NO: 1190 - RNA, 19 nt, Homo sapiens
cagcaaccucuuuccucac

SEQ ID NO: 1191 - RNA, 19 nt, Homo sapiens
ugaggaaagagguugcuga

SEQ ID NO: 1192 - RNA, 19 nt, Homo sapiens
ucagcaaccucuuuccuca

SEQ ID NO: 1193 - RNA, 19 nt, Homo sapiens
gaggaaagagguugcugaa

SEQ ID NO: 1194 - RNA, 19 nt, Homo sapiens
uucagcaaccucuuuccuc

SEQ ID NO: 1195 - RNA, 19 nt, Homo sapiens
aggaaagagguugcugaaa

SEQ ID NO: 1196 - RNA, 19 nt, Homo sapiens
uuucagcaaccucuuuccu

SEQ ID NO: 1197 - RNA, 19 nt, Homo sapiens
ggaaagagguugcugaaac

SEQ ID NO: 1198 - RNA, 19 nt, Homo sapiens
guuucagcaaccucuuucc

SEQ ID NO: 1199 - RNA, 19 nt, Homo sapiens
gaaagagguugcugaaacc

SEQ ID NO: 1200 - RNA, 19 nt, Homo sapiens
gguuucagcaaccucuuuc

SEQ ID NO: 1201 - RNA, 19 nt, Homo sapiens
aaagagguugcugaaaccu

SEQ ID NO: 1202 - RNA, 19 nt, Homo sapiens
agguuucagcaaccucuuu

SEQ ID NO: 1203 - RNA, 19 nt, Homo sapiens
aagagguugcugaaaccuc

SEQ ID NO: 1204 - RNA, 19 nt, Homo sapiens
gagguuucagcaaccucuu

SEQ ID NO: 1205 - RNA, 19 nt, Homo sapiens
agagguugcugaaaccuca

SEQ ID NO: 1206 - RNA, 19 nt, Homo sapiens
ugagguuucagcaaccucu

SEQ ID NO: 1207 - RNA, 19 nt, Homo sapiens
gagguugcugaaaccucag

SEQ ID NO: 1208 - RNA, 19 nt, Homo sapiens
cugagguuucagcaaccuc

SEQ ID NO: 1209 - RNA, 19 nt, Homo sapiens
agguugcugaaaccucagc

SEQ ID NO: 1210 - RNA, 19 nt, Homo sapiens
gcugagguuucagcaaccu

SEQ ID NO: 1211 - RNA, 19 nt, Homo sapiens
gguugcugaaaccucagca

SEQ ID NO: 1212 - RNA, 19 nt, Homo sapiens
ugcugagguuucagcaacc

SEQ ID NO: 1213 - RNA, 19 nt, Homo sapiens
ccccagugugguuagugug

SEQ ID NO: 1214 - RNA, 19 nt, Homo sapiens
cacacuaaccacacugggg

SEQ ID NO: 1215 - RNA, 19 nt, Homo sapiens
agugugguuagugugaaaa

SEQ ID NO: 1216 - RNA, 19 nt, Homo sapiens
uuuucacacuaaccacacu

SEQ ID NO: 1217 - RNA, 19 nt, Homo sapiens
gugugguuagugugaaaac

SEQ ID NO: 1218 - RNA, 19 nt, Homo sapiens
guuuucacacuaaccacac

SEQ ID NO: 1219 - RNA, 19 nt, Homo sapiens
gauggaggggaucccagug

SEQ ID NO: 1220 - RNA, 19 nt, Homo sapiens
cacugggauccccuccauc

SEQ ID NO: 1221 - RNA, 19 nt, Homo sapiens
auggaggggaucccagugg

SEQ ID NO: 1222 - RNA, 19 nt, Homo sapiens
ccacugggauccccuccau

SEQ ID NO: 1223 - RNA, 19 nt, Homo sapiens
cugcugaagaacuuccagg

SEQ ID NO: 1224 - RNA, 19 nt, Homo sapiens
ccuggaaguucuucagcag

SEQ ID NO: 1225 - RNA, 19 nt, Homo sapiens
ugcugaagaacuuccagga

SEQ ID NO: 1226 - RNA, 19 nt, Homo sapiens
uccuggaaguucuucagca

SEQ ID NO: 1227 - RNA, 19 nt, Homo sapiens
gcugaagaacuuccaggac

SEQ ID NO: 1228 - RNA, 19 nt, Homo sapiens
guccuggaaguucuucagc

SEQ ID NO: 1229 - RNA, 19 nt, Homo sapiens
cugaagaacuuccaggaca

SEQ ID NO: 1230 - RNA, 19 nt, Homo sapiens
uguccuggaaguucuucag

SEQ ID NO: 1231 - RNA, 19 nt, Homo sapiens
ugaagaacuuccaggacau

SEQ ID NO: 1232 - RNA, 19 nt, Homo sapiens
auguccuggaaguucuuca

SEQ ID NO: 1233 - RNA, 19 nt, Homo sapiens
gaagaacuuccaggacauc

SEQ ID NO: 1234 - RNA, 19 nt, Homo sapiens
gauguccuggaaguucuuc

SEQ ID NO: 1235 - RNA, 19 nt, Homo sapiens
aagaacuuccaggacauca

SEQ ID NO: 1236 - RNA, 19 nt, Homo sapiens
ugauguccuggaaguucuu

SEQ ID NO: 1237 - RNA, 19 nt, Homo sapiens
agaacuuccaggacaucau

SEQ ID NO: 1238 - RNA, 19 nt, Homo sapiens
augauguccuggaaguucu

SEQ ID NO: 1239 - RNA, 19 nt, Homo sapiens
gaacuuccaggacaucaug

SEQ ID NO: 1240 - RNA, 19 nt, Homo sapiens
caugauguccuggaaguuc

SEQ ID NO: 1241 - RNA, 19 nt, Homo sapiens
aacuuccaggacaucaugc

SEQ ID NO: 1242 - RNA, 19 nt, Homo sapiens
gcaugauguccuggaaguu

SEQ ID NO: 1243 - RNA, 19 nt, Homo sapiens
acuuccaggacaucaugca

SEQ ID NO: 1244 - RNA, 19 nt, Homo sapiens
ugcaugauguccuggaagu

SEQ ID NO: 1245 - RNA, 19 nt, Homo sapiens
cuuccaggacaucaugcaa

SEQ ID NO: 1246 - RNA, 19 nt, Homo sapiens
uugcaugauguccuggaag

SEQ ID NO: 1247 - RNA, 19 nt, Homo sapiens
uuccaggacaucaugcaaa

SEQ ID NO: 1248 - RNA, 19 nt, Homo sapiens
uuugcaugauguccuggaa

SEQ ID NO: 1249 - RNA, 19 nt, Homo sapiens
uccaggacaucaugcaaaa

SEQ ID NO: 1250 - RNA, 19 nt, Homo sapiens
uuuugcaugauguccugga

SEQ ID NO: 1251 - RNA, 19 nt, Homo sapiens
ccaggacaucaugcaaaag

SEQ ID NO: 1252 - RNA, 19 nt, Homo sapiens
cuuuugcaugauguccugg

SEQ ID NO: 1253 - RNA, 19 nt, Homo sapiens
caggacaucaugcaaaagc

SEQ ID NO: 1254 - RNA, 19 nt, Homo sapiens
gcuuuugcaugauguccug

SEQ ID NO: 1255 - RNA, 19 nt, Homo sapiens
aggacaucaugcaaaagca

SEQ ID NO: 1256 - RNA, 19 nt, Homo sapiens
ugcuuuugcaugauguccu

SEQ ID NO: 1257 - RNA, 19 nt, Homo sapiens
ggacaucaugcaaaagcaa

SEQ ID NO: 1258 - RNA, 19 nt, Homo sapiens
uugcuuuugcaugaugucc

SEQ ID NO: 1259 - RNA, 19 nt, Homo sapiens
gacaucaugcaaaagcaaa

SEQ ID NO: 1260 - RNA, 19 nt, Homo sapiens
uuugcuuuugcaugauguc

SEQ ID NO: 1261 - RNA, 19 nt, Homo sapiens
acaucaugcaaaagcaaag

SEQ ID NO: 1262 - RNA, 19 nt, Homo sapiens
cuuugcuuuugcaugaugu

SEQ ID NO: 1263 - RNA, 19 nt, Homo sapiens
aucaugcaaaagcaaagac

SEQ ID NO: 1264 - RNA, 19 nt, Homo sapiens
gucuuugcuuuugcaugau

SEQ ID NO: 1265 - RNA, 19 nt, Homo sapiens
ucaugcaaaagcaaagacc

SEQ ID NO: 1266 - RNA, 19 nt, Homo sapiens
ggucuuugcuuuugcauga

SEQ ID NO: 1267 - RNA, 19 nt, Homo sapiens
caugcaaaagcaaagacca

SEQ ID NO: 1268 - RNA, 19 nt, Homo sapiens
uggucuuugcuuuugcaug

SEQ ID NO: 1269 - RNA, 19 nt, Homo sapiens
augcaaaagcaaagaccag

SEQ ID NO: 1270 - RNA, 19 nt, Homo sapiens
cuggucuuugcuuuugcau

SEQ ID NO: 1271 - RNA, 19 nt, Homo sapiens
ugcaaaagcaaagaccaga

SEQ ID NO: 1272 - RNA, 19 nt, Homo sapiens
ucuggucuuugcuuuugca

SEQ ID NO: 1273 - RNA, 19 nt, Homo sapiens
gcaaaagcaaagaccagaa

SEQ ID NO: 1274 - RNA, 19 nt, Homo sapiens
uucuggucuuugcuuuugc

SEQ ID NO: 1275 - RNA, 19 nt, Homo sapiens
caaaagcaaagaccagaaa

SEQ ID NO: 1276 - RNA, 19 nt, Homo sapiens
uuucuggucuuugcuuuug

SEQ ID NO: 1277 - RNA, 19 nt, Homo sapiens
aaaagcaaagaccagaaag

SEQ ID NO: 1278 - RNA, 19 nt, Homo sapiens
cuuucuggucuuugcuuuu

SEQ ID NO: 1279 - RNA, 19 nt, Homo sapiens
aaagcaaagaccagaaaga

SEQ ID NO: 1280 - RNA, 19 nt, Homo sapiens
ucuuucuggucuuugcuuu

SEQ ID NO: 1281 - RNA, 19 nt, Homo sapiens
aagcaaagaccagaaagag

SEQ ID NO: 1282 - RNA, 19 nt, Homo sapiens
cucuuucuggucuuugcuu

SEQ ID NO: 1283 - RNA, 19 nt, Homo sapiens
agcaaagaccagaaagagu

SEQ ID NO: 1284 - RNA, 19 nt, Homo sapiens
acucuuucuggucuuugcu

SEQ ID NO: 1285 - RNA, 19 nt, Homo sapiens
gcaaagaccagaaagagug

SEQ ID NO: 1286 - RNA, 19 nt, Homo sapiens
cacucuuucuggucuuugc

SEQ ID NO: 1287 - RNA, 19 nt, Homo sapiens
aaagaccagaaagaguguc

SEQ ID NO: 1288 - RNA, 19 nt, Homo sapiens
gacacucuuucuggucuuu

SEQ ID NO: 1289 - RNA, 19 nt, Homo sapiens
aagaccagaaagagugucu

SEQ ID NO: 1290 - RNA, 19 nt, Homo sapiens
agacacucuuucuggucuu

SEQ ID NO: 1291 - RNA, 19 nt, Homo sapiens
agaccagaaagagugucuc

SEQ ID NO: 1292 - RNA, 19 nt, Homo sapiens
gagacacucuuucuggucu

SEQ ID NO: 1293 - RNA, 19 nt, Homo sapiens
gaccagaaagagugucuca

SEQ ID NO: 1294 - RNA, 19 nt, Homo sapiens
ugagacacucuuucugguc

SEQ ID NO: 1295 - RNA, 19 nt, Homo sapiens
accagaaagagugucucau

SEQ ID NO: 1296 - RNA, 19 nt, Homo sapiens
augagacacucuuucuggu

SEQ ID NO: 1297 - RNA, 19 nt, Homo sapiens
ccagaaagagugucucauc

SEQ ID NO: 1298 - RNA, 19 nt, Homo sapiens
gaugagacacucuuucugg

SEQ ID NO: 1299 - RNA, 19 nt, Homo sapiens
gaaagagugucucaucuuc

SEQ ID NO: 1300 - RNA, 19 nt, Homo sapiens
gaagaugagacacucuuuc

SEQ ID NO: 1301 - RNA, 19 nt, Homo sapiens
agagugucucaucuucuuc

SEQ ID NO: 1302 - RNA, 19 nt, Homo sapiens
gaagaagaugagacacucu

SEQ ID NO: 1303 - RNA, 19 nt, Homo sapiens
gagugucucaucuucuuca

SEQ ID NO: 1304 - RNA, 19 nt, Homo sapiens
ugaagaagaugagacacuc

SEQ ID NO: 1305 - RNA, 19 nt, Homo sapiens
agugucucaucuucuucaa

SEQ ID NO: 1306 - RNA, 19 nt, Homo sapiens
uugaagaagaugagacacu

SEQ ID NO: 1307 - RNA, 19 nt, Homo sapiens
gugucucaucuucuucaag

SEQ ID NO: 1308 - RNA, 19 nt, Homo sapiens
cuugaagaagaugagacac

SEQ ID NO: 1309 - RNA, 19 nt, Homo sapiens
ugucucaucuucuucaaga

SEQ ID NO: 1310 - RNA, 19 nt, Homo sapiens
ucuugaagaagaugagaca

SEQ ID NO: 1311 - RNA, 19 nt, Homo sapiens
gucucaucuucuucaagau

SEQ ID NO: 1312 - RNA, 19 nt, Homo sapiens
aucuugaagaagaugagac

SEQ ID NO: 1313 - RNA, 19 nt, Homo sapiens
ucucaucuucuucaagaua

SEQ ID NO: 1314 - RNA, 19 nt, Homo sapiens
uaucuugaagaagaugaga

SEQ ID NO: 1315 - RNA, 19 nt, Homo sapiens
ucaucuucuucaagauaac

SEQ ID NO: 1316 - RNA, 19 nt, Homo sapiens
guuaucuugaagaagauga

SEQ ID NO: 1317 - RNA, 19 nt, Homo sapiens
caucuucuucaagauaacu

SEQ ID NO: 1318 - RNA, 19 nt, Homo sapiens
aguuaucuugaagaagaug

SEQ ID NO: 1319 - RNA, 19 nt, Homo sapiens
aucuucuucaagauaacuu

SEQ ID NO: 1320 - RNA, 19 nt, Homo sapiens
aaguuaucuugaagaagau

SEQ ID NO: 1321 - RNA, 19 nt, Homo sapiens
ucuucuucaagauaacuug

SEQ ID NO: 1322 - RNA, 19 nt, Homo sapiens
caaguuaucuugaagaaga

SEQ ID NO: 1323 - RNA, 19 nt, Homo sapiens
cuucuucaagauaacuugc

SEQ ID NO: 1324 - RNA, 19 nt, Homo sapiens
gcaaguuaucuugaagaag

SEQ ID NO: 1325 - RNA, 19 nt, Homo sapiens
uucuucaagauaacuugcc

SEQ ID NO: 1326 - RNA, 19 nt, Homo sapiens
ggcaaguuaucuugaagaa

SEQ ID NO: 1327 - RNA, 19 nt, Homo sapiens
ucuucaagauaacuugcca

SEQ ID NO: 1328 - RNA, 19 nt, Homo sapiens
uggcaaguuaucuugaaga

SEQ ID NO: 1329 - RNA, 19 nt, Homo sapiens
cuucaagauaacuugccaa

SEQ ID NO: 1330 - RNA, 19 nt, Homo sapiens
uuggcaaguuaucuugaag

SEQ ID NO: 1331 - RNA, 19 nt, Homo sapiens
uucaagauaacuugccaaa

SEQ ID NO: 1332 - RNA, 19 nt, Homo sapiens
uuuggcaaguuaucuugaa

SEQ ID NO: 1333 - RNA, 19 nt, Homo sapiens
ucaagauaacuugccaaaa

SEQ ID NO: 1334 - RNA, 19 nt, Homo sapiens
uuuuggcaaguuaucuuga

SEQ ID NO: 1335 - RNA, 19 nt, Homo sapiens
caagauaacuugccaaaau

SEQ ID NO: 1336 - RNA, 19 nt, Homo sapiens
auuuuggcaaguuaucuug

SEQ ID NO: 1337 - RNA, 19 nt, Homo sapiens
aagauaacuugccaaaauc

SEQ ID NO: 1338 - RNA, 19 nt, Homo sapiens
gauuuuggcaaguuaucuu

SEQ ID NO: 1339 - RNA, 19 nt, Homo sapiens
agauaacuugccaaaaucu

SEQ ID NO: 1340 - RNA, 19 nt, Homo sapiens
agauuuuggcaaguuaucu

SEQ ID NO: 1341 - RNA, 19 nt, Homo sapiens
gauaacuugccaaaaucug

SEQ ID NO: 1342 - RNA, 19 nt, Homo sapiens
cagauuuuggcaaguuauc

SEQ ID NO: 1343 - RNA, 19 nt, Homo sapiens
auaacuugccaaaaucugu

SEQ ID NO: 1344 - RNA, 19 nt, Homo sapiens
acagauuuuggcaaguuau

SEQ ID NO: 1345 - RNA, 19 nt, Homo sapiens
uaacuugccaaaaucuguu

SEQ ID NO: 1346 - RNA, 19 nt, Homo sapiens
aacagauuuuggcaaguua

SEQ ID NO: 1347 - RNA, 19 nt, Homo sapiens
aacuugccaaaaucuguuu

SEQ ID NO: 1348 - RNA, 19 nt, Homo sapiens
aaacagauuuuggcaaguu

SEQ ID NO: 1349 - RNA, 19 nt, Homo sapiens
acuugccaaaaucuguuuc

SEQ ID NO: 1350 - RNA, 19 nt, Homo sapiens
gaaacagauuuuggcaagu

SEQ ID NO: 1351 - RNA, 19 nt, Homo sapiens
cuugccaaaaucuguuucc

SEQ ID NO: 1352 - RNA, 19 nt, Homo sapiens
ggaaacagauuuuggcaag

SEQ ID NO: 1353 - RNA, 19 nt, Homo sapiens
uugccaaaaucuguuucca

SEQ ID NO: 1354 - RNA, 19 nt, Homo sapiens
uggaaacagauuuuggcaa

SEQ ID NO: 1355 - RNA, 19 nt, Homo sapiens
ugccaaaaucuguuuccac

SEQ ID NO: 1356 - RNA, 19 nt, Homo sapiens
guggaaacagauuuuggca

SEQ ID NO: 1357 - RNA, 19 nt, Homo sapiens
gccaaaaucuguuuccacu

SEQ ID NO: 1358 - RNA, 19 nt, Homo sapiens
aguggaaacagauuuuggc

SEQ ID NO: 1359 - RNA, 19 nt, Homo sapiens
ccaaaaucuguuuccacuu

SEQ ID NO: 1360 - RNA, 19 nt, Homo sapiens
aaguggaaacagauuuugg

SEQ ID NO: 1361 - RNA, 19 nt, Homo sapiens
caaaaucuguuuccacuuu

SEQ ID NO: 1362 - RNA, 19 nt, Homo sapiens
aaaguggaaacagauuuug

SEQ ID NO: 1363 - RNA, 19 nt, Homo sapiens
aaaaucuguuuccacuuuu

SEQ ID NO: 1364 - RNA, 19 nt, Homo sapiens
aaaaguggaaacagauuuu

SEQ ID NO: 1365 - RNA, 19 nt, Homo sapiens
aaaucuguuuccacuuuuc

SEQ ID NO: 1366 - RNA, 19 nt, Homo sapiens
gaaaaguggaaacagauuu

SEQ ID NO: 1367 - RNA, 19 nt, Homo sapiens
aaucuguuuccacuuuuca

SEQ ID NO: 1368 - RNA, 19 nt, Homo sapiens
ugaaaaguggaaacagauu

SEQ ID NO: 1369 - RNA, 19 nt, Homo sapiens
aucuguuuccacuuuucag

SEQ ID NO: 1370 - RNA, 19 nt, Homo sapiens
cugaaaaguggaaacagau

SEQ ID NO: 1371 - RNA, 19 nt, Homo sapiens
uguuuccacuuuucaguau

SEQ ID NO: 1372 - RNA, 19 nt, Homo sapiens
auacugaaaaguggaaaca

SEQ ID NO: 1373 - RNA, 19 nt, Homo sapiens
guuuccacuuuucaguaug

SEQ ID NO: 1374 - RNA, 19 nt, Homo sapiens
cauacugaaaaguggaaac

SEQ ID NO: 1375 - RNA, 19 nt, Homo sapiens
uuuccacuuuucaguauga

SEQ ID NO: 1376 - RNA, 19 nt, Homo sapiens
ucauacugaaaaguggaaa

SEQ ID NO: 1377 - RNA, 19 nt, Homo sapiens
uuccacuuuucaguaugau

SEQ ID NO: 1378 - RNA, 19 nt, Homo sapiens
aucauacugaaaaguggaa

SEQ ID NO: 1379 - RNA, 19 nt, Homo sapiens
uccacuuuucaguaugauc

SEQ ID NO: 1380 - RNA, 19 nt, Homo sapiens
gaucauacugaaaagugga

SEQ ID NO: 1381 - RNA, 19 nt, Homo sapiens
ccacuuuucaguaugaucg

SEQ ID NO: 1382 - RNA, 19 nt, Homo sapiens
cgaucauacugaaaagugg

SEQ ID NO: 1383 - RNA, 19 nt, Homo sapiens
uuuucaguaugaucguuuc

SEQ ID NO: 1384 - RNA, 19 nt, Homo sapiens
gaaacgaucauacugaaaa

SEQ ID NO: 1385 - RNA, 19 nt, Homo sapiens
caguaugaucguuucuuug

SEQ ID NO: 1386 - RNA, 19 nt, Homo sapiens
caaagaaacgaucauacug

SEQ ID NO: 1387 - RNA, 19 nt, Homo sapiens
aguaugaucguuucuuuga

SEQ ID NO: 1388 - RNA, 19 nt, Homo sapiens
ucaaagaaacgaucauacu

SEQ ID NO: 1389 - RNA, 19 nt, Homo sapiens
guaugaucguuucuuugag

SEQ ID NO: 1390 - RNA, 19 nt, Homo sapiens
cucaaagaaacgaucauac

SEQ ID NO: 1391 - RNA, 19 nt, Homo sapiens
augaucguuucuuugagaa

SEQ ID NO: 1392 - RNA, 19 nt, Homo sapiens
uucucaaagaaacgaucau

SEQ ID NO: 1393 - RNA, 19 nt, Homo sapiens
ugaucguuucuuugagaaa

SEQ ID NO: 1394 - RNA, 19 nt, Homo sapiens
uuucucaaagaaacgauca

SEQ ID NO: 1395 - RNA, 19 nt, Homo sapiens
aucguuucuuugagaaaaa

SEQ ID NO: 1396 - RNA, 19 nt, Homo sapiens
uuuuucucaaagaaacgau

SEQ ID NO: 1397 - RNA, 19 nt, Homo sapiens
ucguuucuuugagaaaaaa

SEQ ID NO: 1398 - RNA, 19 nt, Homo sapiens
uuuuuucucaaagaaacga

SEQ ID NO: 1399 - RNA, 19 nt, Homo sapiens
cguuucuuugagaaaaaaa

SEQ ID NO: 1400 - RNA, 19 nt, Homo sapiens
uuuuuuucucaaagaaacg

SEQ ID NO: 1401 - RNA, 19 nt, Homo sapiens
guuucuuugagaaaaaaau

SEQ ID NO: 1402 - RNA, 19 nt, Homo sapiens
auuuuuuucucaaagaaac

SEQ ID NO: 1403 - RNA, 19 nt, Homo sapiens
uuucuuugagaaaaaaauu

SEQ ID NO: 1404 - RNA, 19 nt, Homo sapiens
aauuuuuuucucaaagaaa

SEQ ID NO: 1405 - RNA, 19 nt, Homo sapiens
uucuuugagaaaaaaauug

SEQ ID NO: 1406 - RNA, 19 nt, Homo sapiens
caauuuuuuucucaaagaa

SEQ ID NO: 1407 - RNA, 19 nt, Homo sapiens
ucuuugagaaaaaaauuga

SEQ ID NO: 1408 - RNA, 19 nt, Homo sapiens
ucaauuuuuuucucaaaga

SEQ ID NO: 1409 - RNA, 19 nt, Homo sapiens
cuuugagaaaaaaauugau

SEQ ID NO: 1410 - RNA, 19 nt, Homo sapiens
aucaauuuuuuucucaaag

SEQ ID NO: 1411 - RNA, 19 nt, Homo sapiens
uuugagaaaaaaauugaug

SEQ ID NO: 1412 - RNA, 19 nt, Homo sapiens
caucaauuuuuuucucaaa

SEQ ID NO: 1413 - RNA, 19 nt, Homo sapiens
uugagaaaaaaauugauga

SEQ ID NO: 1414 - RNA, 19 nt, Homo sapiens
ucaucaauuuuuuucucaa

SEQ ID NO: 1415 - RNA, 19 nt, Homo sapiens
ugagaaaaaaauugaugag

SEQ ID NO: 1416 - RNA, 19 nt, Homo sapiens
cucaucaauuuuuuucuca

SEQ ID NO: 1417 - RNA, 19 nt, Homo sapiens
gagaaaaaaauugaugaga

SEQ ID NO: 1418 - RNA, 19 nt, Homo sapiens
ucucaucaauuuuuuucuc

SEQ ID NO: 1419 - RNA, 19 nt, Homo sapiens
agaaaaaaauugaugagaa

SEQ ID NO: 1420 - RNA, 19 nt, Homo sapiens
uucucaucaauuuuuuucu

SEQ ID NO: 1421 - RNA, 19 nt, Homo sapiens
gaaaaaaauugaugagaaa

SEQ ID NO: 1422 - RNA, 19 nt, Homo sapiens
uuucucaucaauuuuuuuc

SEQ ID NO: 1423 - RNA, 19 nt, Homo sapiens
aaaaaaauugaugagaaaa

SEQ ID NO: 1424 - RNA, 19 nt, Homo sapiens
uuuucucaucaauuuuuuu

SEQ ID NO: 1425 - RNA, 19 nt, Homo sapiens
aaaaaauugaugagaaaaa

SEQ ID NO: 1426 - RNA, 19 nt, Homo sapiens
uuuuucucaucaauuuuuu

SEQ ID NO: 1427 - RNA, 19 nt, Homo sapiens
aaaaauugaugagaaaaag

SEQ ID NO: 1428 - RNA, 19 nt, Homo sapiens
cuuuuucucaucaauuuuu

SEQ ID NO: 1429 - RNA, 19 nt, Homo sapiens
aaaauugaugagaaaaaga

SEQ ID NO: 1430 - RNA, 19 nt, Homo sapiens
ucuuuuucucaucaauuuu

SEQ ID NO: 1431 - RNA, 19 nt, Homo sapiens
aaauugaugagaaaaagaa

SEQ ID NO: 1432 - RNA, 19 nt, Homo sapiens
uucuuuuucucaucaauuu

SEQ ID NO: 1433 - RNA, 19 nt, Homo sapiens
aauugaugagaaaaagaau

SEQ ID NO: 1434 - RNA, 19 nt, Homo sapiens
auucuuuuucucaucaauu

SEQ ID NO: 1435 - RNA, 19 nt, Homo sapiens
auugaugagaaaaagaaug

SEQ ID NO: 1436 - RNA, 19 nt, Homo sapiens
cauucuuuuucucaucaau

SEQ ID NO: 1437 - RNA, 19 nt, Homo sapiens
uugaugagaaaaagaauga

SEQ ID NO: 1438 - RNA, 19 nt, Homo sapiens
ucauucuuuuucucaucaa

SEQ ID NO: 1439 - RNA, 19 nt, Homo sapiens
ugaugagaaaaagaaugac

SEQ ID NO: 1440 - RNA, 19 nt, Homo sapiens
gucauucuuuuucucauca

SEQ ID NO: 1441 - RNA, 19 nt, Homo sapiens
gaugagaaaaagaaugacc

SEQ ID NO: 1442 - RNA, 19 nt, Homo sapiens
ggucauucuuuuucucauc

SEQ ID NO: 1443 - RNA, 19 nt, Homo sapiens
augagaaaaagaaugacca

SEQ ID NO: 1444 - RNA, 19 nt, Homo sapiens
uggucauucuuuuucucau

SEQ ID NO: 1445 - RNA, 19 nt, Homo sapiens
ugagaaaaagaaugaccac

SEQ ID NO: 1446 - RNA, 19 nt, Homo sapiens
guggucauucuuuuucuca

SEQ ID NO: 1447 - RNA, 19 nt, Homo sapiens
gagaaaaagaaugaccaca

SEQ ID NO: 1448 - RNA, 19 nt, Homo sapiens
uguggucauucuuuuucuc

SEQ ID NO: 1449 - RNA, 19 nt, Homo sapiens
agaaaaagaaugaccacac

SEQ ID NO: 1450 - RNA, 19 nt, Homo sapiens
guguggucauucuuuuucu

SEQ ID NO: 1451 - RNA, 19 nt, Homo sapiens
gaaaaagaaugaccacacc

SEQ ID NO: 1452 - RNA, 19 nt, Homo sapiens
gguguggucauucuuuuuc

SEQ ID NO: 1453 - RNA, 19 nt, Homo sapiens
aaaaagaaugaccacaccu

SEQ ID NO: 1454 - RNA, 19 nt, Homo sapiens
agguguggucauucuuuuu

SEQ ID NO: 1455 - RNA, 19 nt, Homo sapiens
aaaagaaugaccacaccua

SEQ ID NO: 1456 - RNA, 19 nt, Homo sapiens
uagguguggucauucuuuu

SEQ ID NO: 1457 - RNA, 19 nt, Homo sapiens
aaagaaugaccacaccuau

SEQ ID NO: 1458 - RNA, 19 nt, Homo sapiens
auagguguggucauucuuu

SEQ ID NO: 1459 - RNA, 19 nt, Homo sapiens
aagaaugaccacaccuauc

SEQ ID NO: 1460 - RNA, 19 nt, Homo sapiens
gauagguguggucauucuu

SEQ ID NO: 1461 - RNA, 19 nt, Homo sapiens
agaaugaccacaccuaucg

SEQ ID NO: 1462 - RNA, 19 nt, Homo sapiens
cgauagguguggucauucu

SEQ ID NO: 1463 - RNA, 19 nt, Homo sapiens
gaaugaccacaccuaucga

SEQ ID NO: 1464 - RNA, 19 nt, Homo sapiens
ucgauagguguggucauuc

SEQ ID NO: 1465 - RNA, 19 nt, Homo sapiens
aaugaccacaccuaucgag

SEQ ID NO: 1466 - RNA, 19 nt, Homo sapiens
cucgauagguguggucauu

SEQ ID NO: 1467 - RNA, 19 nt, Homo sapiens
augaccacaccuaucgagu

SEQ ID NO: 1468 - RNA, 19 nt, Homo sapiens
acucgauagguguggucau

SEQ ID NO: 1469 - RNA, 19 nt, Homo sapiens
ccacaccuaucgaguuuuu

SEQ ID NO: 1470 - RNA, 19 nt, Homo sapiens
aaaaacucgauaggugugg

SEQ ID NO: 1471 - RNA, 19 nt, Homo sapiens
cacaccuaucgaguuuuua

SEQ ID NO: 1472 - RNA, 19 nt, Homo sapiens
uaaaaacucgauaggugug

SEQ ID NO: 1473 - RNA, 19 nt, Homo sapiens
acaccuaucgaguuuuuaa

SEQ ID NO: 1474 - RNA, 19 nt, Homo sapiens
uuaaaaacucgauaggugu

SEQ ID NO: 1475 - RNA, 19 nt, Homo sapiens
caccuaucgaguuuuuaaa

SEQ ID NO: 1476 - RNA, 19 nt, Homo sapiens
uuuaaaaacucgauaggug

SEQ ID NO: 1477 - RNA, 19 nt, Homo sapiens
accuaucgaguuuuuaaaa

SEQ ID NO: 1478 - RNA, 19 nt, Homo sapiens
uuuuaaaaacucgauaggu

SEQ ID NO: 1479 - RNA, 19 nt, Homo sapiens
ccuaucgaguuuuuaaaac

SEQ ID NO: 1480 - RNA, 19 nt, Homo sapiens
guuuuaaaaacucgauagg

SEQ ID NO: 1481 - RNA, 19 nt, Homo sapiens
cuaucgaguuuuuaaaacu

SEQ ID NO: 1482 - RNA, 19 nt, Homo sapiens
aguuuuaaaaacucgauag

SEQ ID NO: 1483 - RNA, 19 nt, Homo sapiens
uaucgaguuuuuaaaacug

SEQ ID NO: 1484 - RNA, 19 nt, Homo sapiens
caguuuuaaaaacucgaua

SEQ ID NO: 1485 - RNA, 19 nt, Homo sapiens
aucgaguuuuuaaaacugu

SEQ ID NO: 1486 - RNA, 19 nt, Homo sapiens
acaguuuuaaaaacucgau

SEQ ID NO: 1487 - RNA, 19 nt, Homo sapiens
ucgaguuuuuaaaacugug

SEQ ID NO: 1488 - RNA, 19 nt, Homo sapiens
cacaguuuuaaaaacucga

SEQ ID NO: 1489 - RNA, 19 nt, Homo sapiens
cgaguuuuuaaaacuguga

SEQ ID NO: 1490 - RNA, 19 nt, Homo sapiens
ucacaguuuuaaaaacucg

SEQ ID NO: 1491 - RNA, 19 nt, Homo sapiens
gaguuuuuaaaacugugaa

SEQ ID NO: 1492 - RNA, 19 nt, Homo sapiens
uucacaguuuuaaaaacuc

SEQ ID NO: 1493 - RNA, 19 nt, Homo sapiens
aguuuuuaaaacugugaac

SEQ ID NO: 1494 - RNA, 19 nt, Homo sapiens
guucacaguuuuaaaaacu

SEQ ID NO: 1495 - RNA, 19 nt, Homo sapiens
guuuuuaaaacugugaacc

SEQ ID NO: 1496 - RNA, 19 nt, Homo sapiens
gguucacaguuuuaaaaac

SEQ ID NO: 1497 - RNA, 19 nt, Homo sapiens
uuuuuaaaacugugaaccg

SEQ ID NO: 1498 - RNA, 19 nt, Homo sapiens
cgguucacaguuuuaaaaa

SEQ ID NO: 1499 - RNA, 19 nt, Homo sapiens
uuuuaaaacugugaaccgg

SEQ ID NO: 1500 - RNA, 19 nt, Homo sapiens
ccgguucacaguuuuaaaa

SEQ ID NO: 1501 - RNA, 19 nt, Homo sapiens
uuuaaaacugugaaccggc

SEQ ID NO: 1502 - RNA, 19 nt, Homo sapiens
gccgguucacaguuuuaaa

SEQ ID NO: 1503 - RNA, 19 nt, Homo sapiens
uuaaaacugugaaccggcg

SEQ ID NO: 1504 - RNA, 19 nt, Homo sapiens
cgccgguucacaguuuuaa

SEQ ID NO: 1505 - RNA, 19 nt, Homo sapiens
uaaaacugugaaccggcga

SEQ ID NO: 1506 - RNA, 19 nt, Homo sapiens
ucgccgguucacaguuuua

SEQ ID NO: 1507 - RNA, 19 nt, Homo sapiens
aaaacugugaaccggcgag

SEQ ID NO: 1508 - RNA, 19 nt, Homo sapiens
cucgccgguucacaguuuu

SEQ ID NO: 1509 - RNA, 19 nt, Homo sapiens
aaacugugaaccggcgagc

SEQ ID NO: 1510 - RNA, 19 nt, Homo sapiens
gcucgccgguucacaguuu

SEQ ID NO: 1511 - RNA, 19 nt, Homo sapiens
aacugugaaccggcgagca

SEQ ID NO: 1512 - RNA, 19 nt, Homo sapiens
ugcucgccgguucacaguu

SEQ ID NO: 1513 - RNA, 19 nt, Homo sapiens
acugugaaccggcgagcac

SEQ ID NO: 1514 - RNA, 19 nt, Homo sapiens
gugcucgccgguucacagu

SEQ ID NO: 1515 - RNA, 19 nt, Homo sapiens
cugugaaccggcgagcaca

SEQ ID NO: 1516 - RNA, 19 nt, Homo sapiens
ugugcucgccgguucacag

SEQ ID NO: 1517 - RNA, 19 nt, Homo sapiens
ugugaaccggcgagcacac

SEQ ID NO: 1518 - RNA, 19 nt, Homo sapiens
gugugcucgccgguucaca

SEQ ID NO: 1519 - RNA, 19 nt, Homo sapiens
gugaaccggcgagcacaca

SEQ ID NO: 1520 - RNA, 19 nt, Homo sapiens
ugugugcucgccgguucac

SEQ ID NO: 1521 - RNA, 19 nt, Homo sapiens
ugaaccggcgagcacacau

SEQ ID NO: 1522 - RNA, 19 nt, Homo sapiens
augugugcucgccgguuca

SEQ ID NO: 1523 - RNA, 19 nt, Homo sapiens
gaaccggcgagcacacauc

SEQ ID NO: 1524 - RNA, 19 nt, Homo sapiens
gaugugugcucgccgguuc

SEQ ID NO: 1525 - RNA, 19 nt, Homo sapiens
aaccggcgagcacacaucu

SEQ ID NO: 1526 - RNA, 19 nt, Homo sapiens
agaugugugcucgccgguu

SEQ ID NO: 1527 - RNA, 19 nt, Homo sapiens
accggcgagcacacaucuu

SEQ ID NO: 1528 - RNA, 19 nt, Homo sapiens
aagaugugugcucgccggu

SEQ ID NO: 1529 - RNA, 19 nt, Homo sapiens
ccggcgagcacacaucuuc

SEQ ID NO: 1530 - RNA, 19 nt, Homo sapiens
gaagaugugugcucgccgg

SEQ ID NO: 1531 - RNA, 19 nt, Homo sapiens
cggcgagcacacaucuucc

SEQ ID NO: 1532 - RNA, 19 nt, Homo sapiens
ggaagaugugugcucgccg

SEQ ID NO: 1533 - RNA, 19 nt, Homo sapiens
ggcgagcacacaucuuccc

SEQ ID NO: 1534 - RNA, 19 nt, Homo sapiens
gggaagaugugugcucgcc

SEQ ID NO: 1535 - RNA, 19 nt, Homo sapiens
auggcagaugacuauucag

SEQ ID NO: 1536 - RNA, 19 nt, Homo sapiens
cugaauagucaucugccau

SEQ ID NO: 1537 - RNA, 19 nt, Homo sapiens
ggcagaugacuauucagac

SEQ ID NO: 1538 - RNA, 19 nt, Homo sapiens
gucugaauagucaucugcc

SEQ ID NO: 1539 - RNA, 19 nt, Homo sapiens
gcagaugacuauucagacu

SEQ ID NO: 1540 - RNA, 19 nt, Homo sapiens
agucugaauagucaucugc

SEQ ID NO: 1541 - RNA, 19 nt, Homo sapiens
cagaugacuauucagacuc

SEQ ID NO: 1542 - RNA, 19 nt, Homo sapiens
gagucugaauagucaucug

SEQ ID NO: 1543 - RNA, 19 nt, Homo sapiens
agaugacuauucagacucc

SEQ ID NO: 1544 - RNA, 19 nt, Homo sapiens
ggagucugaauagucaucu

SEQ ID NO: 1545 - RNA, 19 nt, Homo sapiens
gaugacuauucagacuccc

SEQ ID NO: 1546 - RNA, 19 nt, Homo sapiens
gggagucugaauagucauc

SEQ ID NO: 1547 - RNA, 19 nt, Homo sapiens
augacuauucagacucccu

SEQ ID NO: 1548 - RNA, 19 nt, Homo sapiens
agggagucugaauagucau

SEQ ID NO: 1549 - RNA, 19 nt, Homo sapiens
ugacuauucagacucccuc

SEQ ID NO: 1550 - RNA, 19 nt, Homo sapiens
gagggagucugaauaguca

SEQ ID NO: 1551 - RNA, 19 nt, Homo sapiens
gacuauucagacucccuca

SEQ ID NO: 1552 - RNA, 19 nt, Homo sapiens
ugagggagucugaauaguc

SEQ ID NO: 1553 - RNA, 19 nt, Homo sapiens
acuauucagacucccucau

SEQ ID NO: 1554 - RNA, 19 nt, Homo sapiens
augagggagucugaauagu

SEQ ID NO: 1555 - RNA, 19 nt, Homo sapiens
cuauucagacucccucauc

SEQ ID NO: 1556 - RNA, 19 nt, Homo sapiens
gaugagggagucugaauag

SEQ ID NO: 1557 - RNA, 19 nt, Homo sapiens
uauucagacucccucauca

SEQ ID NO: 1558 - RNA, 19 nt, Homo sapiens
ugaugagggagucugaaua

SEQ ID NO: 1559 - RNA, 19 nt, Homo sapiens
auucagacucccucaucac

SEQ ID NO: 1560 - RNA, 19 nt, Homo sapiens
gugaugagggagucugaau

SEQ ID NO: 1561 - RNA, 19 nt, Homo sapiens
uucagacucccucaucacc

SEQ ID NO: 1562 - RNA, 19 nt, Homo sapiens
ggugaugagggagucugaa

SEQ ID NO: 1563 - RNA, 19 nt, Homo sapiens
ucagacucccucaucacca

SEQ ID NO: 1564 - RNA, 19 nt, Homo sapiens
uggugaugagggagucuga

SEQ ID NO: 1565 - RNA, 19 nt, Homo sapiens
cagacucccucaucaccaa

SEQ ID NO: 1566 - RNA, 19 nt, Homo sapiens
uuggugaugagggagucug

SEQ ID NO: 1567 - RNA, 19 nt, Homo sapiens
agacucccucaucaccaaa

SEQ ID NO: 1568 - RNA, 19 nt, Homo sapiens
uuuggugaugagggagucu

SEQ ID NO: 1569 - RNA, 19 nt, Homo sapiens
gacucccucaucaccaaaa

SEQ ID NO: 1570 - RNA, 19 nt, Homo sapiens
uuuuggugaugagggaguc

SEQ ID NO: 1571 - RNA, 19 nt, Homo sapiens
acucccucaucaccaaaaa

SEQ ID NO: 1572 - RNA, 19 nt, Homo sapiens
uuuuuggugaugagggagu

SEQ ID NO: 1573 - RNA, 19 nt, Homo sapiens
cucccucaucaccaaaaag

SEQ ID NO: 1574 - RNA, 19 nt, Homo sapiens
cuuuuuggugaugagggag

SEQ ID NO: 1575 - RNA, 19 nt, Homo sapiens
ucccucaucaccaaaaagc

SEQ ID NO: 1576 - RNA, 19 nt, Homo sapiens
gcuuuuuggugaugaggga

SEQ ID NO: 1577 - RNA, 19 nt, Homo sapiens
cccucaucaccaaaaagca

SEQ ID NO: 1578 - RNA, 19 nt, Homo sapiens
ugcuuuuuggugaugaggg

SEQ ID NO: 1579 - RNA, 19 nt, Homo sapiens
gugucagucuggugcagua

SEQ ID NO: 1580 - RNA, 19 nt, Homo sapiens
uacugcaccagacugacac

SEQ ID NO: 1581 - RNA, 19 nt, Homo sapiens
ugucagucuggugcaguaa

SEQ ID NO: 1582 - RNA, 19 nt, Homo sapiens
uuacugcaccagacugaca

SEQ ID NO: 1583 - RNA, 19 nt, Homo sapiens
gucagucuggugcaguaau

SEQ ID NO: 1584 - RNA, 19 nt, Homo sapiens
auuacugcaccagacugac

SEQ ID NO: 1585 - RNA, 19 nt, Homo sapiens
ucagucuggugcaguaaug

SEQ ID NO: 1586 - RNA, 19 nt, Homo sapiens
cauuacugcaccagacuga

SEQ ID NO: 1587 - RNA, 19 nt, Homo sapiens
cagucuggugcaguaauga

SEQ ID NO: 1588 - RNA, 19 nt, Homo sapiens
ucauuacugcaccagacug

SEQ ID NO: 1589 - RNA, 19 nt, Homo sapiens
agucuggugcaguaaugac

SEQ ID NO: 1590 - RNA, 19 nt, Homo sapiens
gucauuacugcaccagacu

SEQ ID NO: 1591 - RNA, 19 nt, Homo sapiens
cuggugcaguaaugacuac

SEQ ID NO: 1592 - RNA, 19 nt, Homo sapiens
guagucauuacugcaccag

SEQ ID NO: 1593 - RNA, 19 nt, Homo sapiens
uggugcaguaaugacuacc

SEQ ID NO: 1594 - RNA, 19 nt, Homo sapiens
gguagucauuacugcacca

SEQ ID NO: 1595 - RNA, 19 nt, Homo sapiens
gugcaguaaugacuaccua

SEQ ID NO: 1596 - RNA, 19 nt, Homo sapiens
uagguagucauuacugcac

SEQ ID NO: 1597 - RNA, 19 nt, Homo sapiens
ugcaguaaugacuaccuag

SEQ ID NO: 1598 - RNA, 19 nt, Homo sapiens
cuagguagucauuacugca

SEQ ID NO: 1599 - RNA, 19 nt, Homo sapiens
gcaguaaugacuaccuagg

SEQ ID NO: 1600 - RNA, 19 nt, Homo sapiens
ccuagguagucauuacugc

SEQ ID NO: 1601 - RNA, 19 nt, Homo sapiens
caguaaugacuaccuagga

SEQ ID NO: 1602 - RNA, 19 nt, Homo sapiens
uccuagguagucauuacug

SEQ ID NO: 1603 - RNA, 19 nt, Homo sapiens
aguaaugacuaccuaggaa

SEQ ID NO: 1604 - RNA, 19 nt, Homo sapiens
uuccuagguagucauuacu

SEQ ID NO: 1605 - RNA, 19 nt, Homo sapiens
guaaugacuaccuaggaau

SEQ ID NO: 1606 - RNA, 19 nt, Homo sapiens
auuccuagguagucauuac

SEQ ID NO: 1607 - RNA, 19 nt, Homo sapiens
uaaugacuaccuaggaaug

SEQ ID NO: 1608 - RNA, 19 nt, Homo sapiens
cauuccuagguagucauua

SEQ ID NO: 1609 - RNA, 19 nt, Homo sapiens
aaugacuaccuaggaauga

SEQ ID NO: 1610 - RNA, 19 nt, Homo sapiens
ucauuccuagguagucauu

SEQ ID NO: 1611 - RNA, 19 nt, Homo sapiens
augacuaccuaggaaugag

SEQ ID NO: 1612 - RNA, 19 nt, Homo sapiens
cucauuccuagguagucau

SEQ ID NO: 1613 - RNA, 19 nt, Homo sapiens
ugacuaccuaggaaugagu

SEQ ID NO: 1614 - RNA, 19 nt, Homo sapiens
acucauuccuagguaguca

SEQ ID NO: 1615 - RNA, 19 nt, Homo sapiens
gacuaccuaggaaugaguc

SEQ ID NO: 1616 - RNA, 19 nt, Homo sapiens
gacucauuccuagguaguc

SEQ ID NO: 1617 - RNA, 19 nt, Homo sapiens
acuaccuaggaaugagucg

SEQ ID NO: 1618 - RNA, 19 nt, Homo sapiens
cgacucauuccuagguagu

SEQ ID NO: 1619 - RNA, 19 nt, Homo sapiens
cuaccuaggaaugagucgc

SEQ ID NO: 1620 - RNA, 19 nt, Homo sapiens
gcgacucauuccuagguag

SEQ ID NO: 1621 - RNA, 19 nt, Homo sapiens
uaccuaggaaugagucgcc

SEQ ID NO: 1622 - RNA, 19 nt, Homo sapiens
ggcgacucauuccuaggua

SEQ ID NO: 1623 - RNA, 19 nt, Homo sapiens
accuaggaaugagucgcca

SEQ ID NO: 1624 - RNA, 19 nt, Homo sapiens
uggcgacucauuccuaggu

SEQ ID NO: 1625 - RNA, 19 nt, Homo sapiens
ccuaggaaugagucgccac

SEQ ID NO: 1626 - RNA, 19 nt, Homo sapiens
guggcgacucauuccuagg

SEQ ID NO: 1627 - RNA, 19 nt, Homo sapiens
cuaggaaugagucgccacc

SEQ ID NO: 1628 - RNA, 19 nt, Homo sapiens
gguggcgacucauuccuag

SEQ ID NO: 1629 - RNA, 19 nt, Homo sapiens
uaggaaugagucgccaccc

SEQ ID NO: 1630 - RNA, 19 nt, Homo sapiens
ggguggcgacucauuccua

SEQ ID NO: 1631 - RNA, 19 nt, Homo sapiens
aggaaugagucgccaccca

SEQ ID NO: 1632 - RNA, 19 nt, Homo sapiens
uggguggcgacucauuccu

SEQ ID NO: 1633 - RNA, 19 nt, Homo sapiens
ggaaugagucgccacccac

SEQ ID NO: 1634 - RNA, 19 nt, Homo sapiens
guggguggcgacucauucc

SEQ ID NO: 1635 - RNA, 19 nt, Homo sapiens
gaaugagucgccacccacg

SEQ ID NO: 1636 - RNA, 19 nt, Homo sapiens
cguggguggcgacucauuc

SEQ ID NO: 1637 - RNA, 19 nt, Homo sapiens
aaugagucgccacccacgg

SEQ ID NO: 1638 - RNA, 19 nt, Homo sapiens
ccguggguggcgacucauu

SEQ ID NO: 1639 - RNA, 19 nt, Homo sapiens
augagucgccacccacggg

SEQ ID NO: 1640 - RNA, 19 nt, Homo sapiens
cccguggguggcgacucau

SEQ ID NO: 1641 - RNA, 19 nt, Homo sapiens
ugagucgccacccacgggu

SEQ ID NO: 1642 - RNA, 19 nt, Homo sapiens
acccguggguggcgacuca

SEQ ID NO: 1643 - RNA, 19 nt, Homo sapiens
gagucgccacccacgggug

SEQ ID NO: 1644 - RNA, 19 nt, Homo sapiens
cacccguggguggcgacuc

SEQ ID NO: 1645 - RNA, 19 nt, Homo sapiens
agucgccacccacgggugu

SEQ ID NO: 1646 - RNA, 19 nt, Homo sapiens
acacccguggguggcgacu

SEQ ID NO: 1647 - RNA, 19 nt, Homo sapiens
gucgccacccacgggugug

SEQ ID NO: 1648 - RNA, 19 nt, Homo sapiens
cacacccguggguggcgac

SEQ ID NO: 1649 - RNA, 19 nt, Homo sapiens
ucgccacccacgggugugu

SEQ ID NO: 1650 - RNA, 19 nt, Homo sapiens
acacacccguggguggcga

SEQ ID NO: 1651 - RNA, 19 nt, Homo sapiens
cgccacccacgggugugug

SEQ ID NO: 1652 - RNA, 19 nt, Homo sapiens
cacacacccguggguggcg

SEQ ID NO: 1653 - RNA, 19 nt, Homo sapiens
gccacccacgggugugugg

SEQ ID NO: 1654 - RNA, 19 nt, Homo sapiens
ccacacacccguggguggc

SEQ ID NO: 1655 - RNA, 19 nt, Homo sapiens
ccacccacggguguguggg

SEQ ID NO: 1656 - RNA, 19 nt, Homo sapiens
cccacacacccgugggugg

SEQ ID NO: 1657 - RNA, 19 nt, Homo sapiens
cacccacgggugugugggg

SEQ ID NO: 1658 - RNA, 19 nt, Homo sapiens
ccccacacacccgugggug

SEQ ID NO: 1659 - RNA, 19 nt, Homo sapiens
acccacggguguguggggc

SEQ ID NO: 1660 - RNA, 19 nt, Homo sapiens
gccccacacacccgugggu

SEQ ID NO: 1661 - RNA, 19 nt, Homo sapiens
cccacggguguguggggca

SEQ ID NO: 1662 - RNA, 19 nt, Homo sapiens
ugccccacacacccguggg

SEQ ID NO: 1663 - RNA, 19 nt, Homo sapiens
ccacggguguguggggcag

SEQ ID NO: 1664 - RNA, 19 nt, Homo sapiens
cugccccacacacccgugg

SEQ ID NO: 1665 - RNA, 19 nt, Homo sapiens
cacggguguguggggcagu

SEQ ID NO: 1666 - RNA, 19 nt, Homo sapiens
acugccccacacacccgug

SEQ ID NO: 1667 - RNA, 19 nt, Homo sapiens
acggguguguggggcaguu

SEQ ID NO: 1668 - RNA, 19 nt, Homo sapiens
aacugccccacacacccgu

SEQ ID NO: 1669 - RNA, 19 nt, Homo sapiens
cggguguguggggcaguua

SEQ ID NO: 1670 - RNA, 19 nt, Homo sapiens
uaacugccccacacacccg

SEQ ID NO: 1671 - RNA, 19 nt, Homo sapiens
ggguguguggggcaguuau

SEQ ID NO: 1672 - RNA, 19 nt, Homo sapiens
auaacugccccacacaccc

SEQ ID NO: 1673 - RNA, 19 nt, Homo sapiens
gguguguggggcaguuaug

SEQ ID NO: 1674 - RNA, 19 nt, Homo sapiens
cauaacugccccacacacc

SEQ ID NO: 1675 - RNA, 19 nt, Homo sapiens
guguguggggcaguuaugg

SEQ ID NO: 1676 - RNA, 19 nt, Homo sapiens
ccauaacugccccacacac

SEQ ID NO: 1677 - RNA, 19 nt, Homo sapiens
uguguggggcaguuaugga

SEQ ID NO: 1678 - RNA, 19 nt, Homo sapiens
uccauaacugccccacaca

SEQ ID NO: 1679 - RNA, 19 nt, Homo sapiens
guguggggcaguuauggac

SEQ ID NO: 1680 - RNA, 19 nt, Homo sapiens
guccauaacugccccacac

SEQ ID NO: 1681 - RNA, 19 nt, Homo sapiens
guggggcaguuauggacac

SEQ ID NO: 1682 - RNA, 19 nt, Homo sapiens
guguccauaacugccccac

SEQ ID NO: 1683 - RNA, 19 nt, Homo sapiens
uggggcaguuauggacacu

SEQ ID NO: 1684 - RNA, 19 nt, Homo sapiens
aguguccauaacugcccca

SEQ ID NO: 1685 - RNA, 19 nt, Homo sapiens
gggcaguuauggacacuuu

SEQ ID NO: 1686 - RNA, 19 nt, Homo sapiens
aaaguguccauaacugccc

SEQ ID NO: 1687 - RNA, 19 nt, Homo sapiens
ggcaguuauggacacuuug

SEQ ID NO: 1688 - RNA, 19 nt, Homo sapiens
caaaguguccauaacugcc

SEQ ID NO: 1689 - RNA, 19 nt, Homo sapiens
gcaguuauggacacuuuga

SEQ ID NO: 1690 - RNA, 19 nt, Homo sapiens
ucaaaguguccauaacugc

SEQ ID NO: 1691 - RNA, 19 nt, Homo sapiens
caguuauggacacuuugaa

SEQ ID NO: 1692 - RNA, 19 nt, Homo sapiens
uucaaaguguccauaacug

SEQ ID NO: 1693 - RNA, 19 nt, Homo sapiens
aguuauggacacuuugaaa

SEQ ID NO: 1694 - RNA, 19 nt, Homo sapiens
uuucaaaguguccauaacu

SEQ ID NO: 1695 - RNA, 19 nt, Homo sapiens
guuauggacacuuugaaac

SEQ ID NO: 1696 - RNA, 19 nt, Homo sapiens
guuucaaaguguccauaac

SEQ ID NO: 1697 - RNA, 19 nt, Homo sapiens
uuauggacacuuugaaaca

SEQ ID NO: 1698 - RNA, 19 nt, Homo sapiens
uguuucaaaguguccauaa

SEQ ID NO: 1699 - RNA, 19 nt, Homo sapiens
uauggacacuuugaaacaa

SEQ ID NO: 1700 - RNA, 19 nt, Homo sapiens
uuguuucaaaguguccaua

SEQ ID NO: 1701 - RNA, 19 nt, Homo sapiens
auggacacuuugaaacaac

SEQ ID NO: 1702 - RNA, 19 nt, Homo sapiens
guuguuucaaaguguccau

SEQ ID NO: 1703 - RNA, 19 nt, Homo sapiens
gacacuuugaaacaacaug

SEQ ID NO: 1704 - RNA, 19 nt, Homo sapiens
cauguuguuucaaaguguc

SEQ ID NO: 1705 - RNA, 19 nt, Homo sapiens
acacuuugaaacaacaugg

SEQ ID NO: 1706 - RNA, 19 nt, Homo sapiens
ccauguuguuucaaagugu

SEQ ID NO: 1707 - RNA, 19 nt, Homo sapiens
cacuuugaaacaacauggu

SEQ ID NO: 1708 - RNA, 19 nt, Homo sapiens
accauguuguuucaaagug

SEQ ID NO: 1709 - RNA, 19 nt, Homo sapiens
acuuugaaacaacauggug

SEQ ID NO: 1710 - RNA, 19 nt, Homo sapiens
caccauguuguuucaaagu

SEQ ID NO: 1711 - RNA, 19 nt, Homo sapiens
cuuugaaacaacauggugc

SEQ ID NO: 1712 - RNA, 19 nt, Homo sapiens
gcaccauguuguuucaaag

SEQ ID NO: 1713 - RNA, 19 nt, Homo sapiens
uuugaaacaacauggugcu

SEQ ID NO: 1714 - RNA, 19 nt, Homo sapiens
agcaccauguuguuucaaa

SEQ ID NO: 1715 - RNA, 19 nt, Homo sapiens
uugaaacaacauggugcug

SEQ ID NO: 1716 - RNA, 19 nt, Homo sapiens
cagcaccauguuguuucaa

SEQ ID NO: 1717 - RNA, 19 nt, Homo sapiens
ugaaacaacauggugcugg

SEQ ID NO: 1718 - RNA, 19 nt, Homo sapiens
ccagcaccauguuguuuca

SEQ ID NO: 1719 - RNA, 19 nt, Homo sapiens
gaaacaacauggugcuggg

SEQ ID NO: 1720 - RNA, 19 nt, Homo sapiens
cccagcaccauguuguuuc

SEQ ID NO: 1721 - RNA, 19 nt, Homo sapiens
aaacaacauggugcugggg

SEQ ID NO: 1722 - RNA, 19 nt, Homo sapiens
ccccagcaccauguuguuu

SEQ ID NO: 1723 - RNA, 19 nt, Homo sapiens
aacaacauggugcuggggc

SEQ ID NO: 1724 - RNA, 19 nt, Homo sapiens
gccccagcaccauguuguu

SEQ ID NO: 1725 - RNA, 19 nt, Homo sapiens
acaacauggugcuggggca

SEQ ID NO: 1726 - RNA, 19 nt, Homo sapiens
ugccccagcaccauguugu

SEQ ID NO: 1727 - RNA, 19 nt, Homo sapiens
caacauggugcuggggcag

SEQ ID NO: 1728 - RNA, 19 nt, Homo sapiens
cugccccagcaccauguug

SEQ ID NO: 1729 - RNA, 19 nt, Homo sapiens
aacauggugcuggggcagg

SEQ ID NO: 1730 - RNA, 19 nt, Homo sapiens
ccugccccagcaccauguu

SEQ ID NO: 1731 - RNA, 19 nt, Homo sapiens
acauggugcuggggcaggu

SEQ ID NO: 1732 - RNA, 19 nt, Homo sapiens
accugccccagcaccaugu

SEQ ID NO: 1733 - RNA, 19 nt, Homo sapiens
cauggugcuggggcaggug

SEQ ID NO: 1734 - RNA, 19 nt, Homo sapiens
caccugccccagcaccaug

SEQ ID NO: 1735 - RNA, 19 nt, Homo sapiens
auggugcuggggcaggugg

SEQ ID NO: 1736 - RNA, 19 nt, Homo sapiens
ccaccugccccagcaccau

SEQ ID NO: 1737 - RNA, 19 nt, Homo sapiens
uggugcuggggcagguggu

SEQ ID NO: 1738 - RNA, 19 nt, Homo sapiens
accaccugccccagcacca

SEQ ID NO: 1739 - RNA, 19 nt, Homo sapiens
ggugcuggggcagguggua

SEQ ID NO: 1740 - RNA, 19 nt, Homo sapiens
uaccaccugccccagcacc

SEQ ID NO: 1741 - RNA, 19 nt, Homo sapiens
gugcuggggcaggugguac

SEQ ID NO: 1742 - RNA, 19 nt, Homo sapiens
guaccaccugccccagcac

SEQ ID NO: 1743 - RNA, 19 nt, Homo sapiens
ugcuggggcaggugguacu

SEQ ID NO: 1744 - RNA, 19 nt, Homo sapiens
aguaccaccugccccagca

SEQ ID NO: 1745 - RNA, 19 nt, Homo sapiens
gcuggggcaggugguacua

SEQ ID NO: 1746 - RNA, 19 nt, Homo sapiens
uaguaccaccugccccagc

SEQ ID NO: 1747 - RNA, 19 nt, Homo sapiens
cuggggcaggugguacuag

SEQ ID NO: 1748 - RNA, 19 nt, Homo sapiens
cuaguaccaccugccccag

SEQ ID NO: 1749 - RNA, 19 nt, Homo sapiens
uggggcaggugguacuaga

SEQ ID NO: 1750 - RNA, 19 nt, Homo sapiens
ucuaguaccaccugcccca

SEQ ID NO: 1751 - RNA, 19 nt, Homo sapiens
gcaggugguacuagaaaua

SEQ ID NO: 1752 - RNA, 19 nt, Homo sapiens
uauuucuaguaccaccugc

SEQ ID NO: 1753 - RNA, 19 nt, Homo sapiens
caggugguacuagaaauau

SEQ ID NO: 1754 - RNA, 19 nt, Homo sapiens
auauuucuaguaccaccug

SEQ ID NO: 1755 - RNA, 19 nt, Homo sapiens
aggugguacuagaaauauu

SEQ ID NO: 1756 - RNA, 19 nt, Homo sapiens
aauauuucuaguaccaccu

SEQ ID NO: 1757 - RNA, 19 nt, Homo sapiens
ggugguacuagaaauauuu

SEQ ID NO: 1758 - RNA, 19 nt, Homo sapiens
aaauauuucuaguaccacc

SEQ ID NO: 1759 - RNA, 19 nt, Homo sapiens
gugguacuagaaauauuuc

SEQ ID NO: 1760 - RNA, 19 nt, Homo sapiens
gaaauauuucuaguaccac

SEQ ID NO: 1761 - RNA, 19 nt, Homo sapiens
ugguacuagaaauauuucu

SEQ ID NO: 1762 - RNA, 19 nt, Homo sapiens
agaaauauuucuaguacca

SEQ ID NO: 1763 - RNA, 19 nt, Homo sapiens
gguacuagaaauauuucug

SEQ ID NO: 1764 - RNA, 19 nt, Homo sapiens
cagaaauauuucuaguacc

SEQ ID NO: 1765 - RNA, 19 nt, Homo sapiens
guacuagaaauauuucugg

SEQ ID NO: 1766 - RNA, 19 nt, Homo sapiens
ccagaaauauuucuaguac

SEQ ID NO: 1767 - RNA, 19 nt, Homo sapiens
uacuagaaauauuucugga

SEQ ID NO: 1768 - RNA, 19 nt, Homo sapiens
uccagaaauauuucuagua

SEQ ID NO: 1769 - RNA, 19 nt, Homo sapiens
acuagaaauauuucuggaa

SEQ ID NO: 1770 - RNA, 19 nt, Homo sapiens
uuccagaaauauuucuagu

SEQ ID NO: 1771 - RNA, 19 nt, Homo sapiens
cuagaaauauuucuggaac

SEQ ID NO: 1772 - RNA, 19 nt, Homo sapiens
guuccagaaauauuucuag

SEQ ID NO: 1773 - RNA, 19 nt, Homo sapiens
uagaaauauuucuggaacu

SEQ ID NO: 1774 - RNA, 19 nt, Homo sapiens
aguuccagaaauauuucua

SEQ ID NO: 1775 - RNA, 19 nt, Homo sapiens
agaaauauuucuggaacua

SEQ ID NO: 1776 - RNA, 19 nt, Homo sapiens
uaguuccagaaauauuucu

SEQ ID NO: 1777 - RNA, 19 nt, Homo sapiens
gaaauauuucuggaacuag

SEQ ID NO: 1778 - RNA, 19 nt, Homo sapiens
cuaguuccagaaauauuuc

SEQ ID NO: 1779 - RNA, 19 nt, Homo sapiens
aaauauuucuggaacuagu

SEQ ID NO: 1780 - RNA, 19 nt, Homo sapiens
acuaguuccagaaauauuu

SEQ ID NO: 1781 - RNA, 19 nt, Homo sapiens
aauauuucuggaacuagua

SEQ ID NO: 1782 - RNA, 19 nt, Homo sapiens
uacuaguuccagaaauauu

SEQ ID NO: 1783 - RNA, 19 nt, Homo sapiens
uauuucuggaacuaguaaa

SEQ ID NO: 1784 - RNA, 19 nt, Homo sapiens
uuuacuaguuccagaaaua

SEQ ID NO: 1785 - RNA, 19 nt, Homo sapiens
uucuggaacuaguaaauuc

SEQ ID NO: 1786 - RNA, 19 nt, Homo sapiens
gaauuuacuaguuccagaa

SEQ ID NO: 1787 - RNA, 19 nt, Homo sapiens
ucuggaacuaguaaauucc

SEQ ID NO: 1788 - RNA, 19 nt, Homo sapiens
ggaauuuacuaguuccaga

SEQ ID NO: 1789 - RNA, 19 nt, Homo sapiens
uggaacuaguaaauuccau

SEQ ID NO: 1790 - RNA, 19 nt, Homo sapiens
auggaauuuacuaguucca

SEQ ID NO: 1791 - RNA, 19 nt, Homo sapiens
ggaacuaguaaauuccaug

SEQ ID NO: 1792 - RNA, 19 nt, Homo sapiens
cauggaauuuacuaguucc

SEQ ID NO: 1793 - RNA, 19 nt, Homo sapiens
aacuaguaaauuccaugug

SEQ ID NO: 1794 - RNA, 19 nt, Homo sapiens
cacauggaauuuacuaguu

SEQ ID NO: 1795 - RNA, 19 nt, Homo sapiens
acuaguaaauuccaugugg

SEQ ID NO: 1796 - RNA, 19 nt, Homo sapiens
ccacauggaauuuacuagu

SEQ ID NO: 1797 - RNA, 19 nt, Homo sapiens
cuaguaaauuccaugugga

SEQ ID NO: 1798 - RNA, 19 nt, Homo sapiens
uccacauggaauuuacuag

SEQ ID NO: 1799 - RNA, 19 nt, Homo sapiens
uaguaaauuccauguggac

SEQ ID NO: 1800 - RNA, 19 nt, Homo sapiens
guccacauggaauuuacua

SEQ ID NO: 1801 - RNA, 19 nt, Homo sapiens
aguaaauuccauguggacu

SEQ ID NO: 1802 - RNA, 19 nt, Homo sapiens
aguccacauggaauuuacu

SEQ ID NO: 1803 - RNA, 19 nt, Homo sapiens
guaaauuccauguggacuu

SEQ ID NO: 1804 - RNA, 19 nt, Homo sapiens
aaguccacauggaauuuac

SEQ ID NO: 1805 - RNA, 19 nt, Homo sapiens
uaaauuccauguggacuua

SEQ ID NO: 1806 - RNA, 19 nt, Homo sapiens
uaaguccacauggaauuua

SEQ ID NO: 1807 - RNA, 19 nt, Homo sapiens
aaauuccauguggacuuag

SEQ ID NO: 1808 - RNA, 19 nt, Homo sapiens
cuaaguccacauggaauuu

SEQ ID NO: 1809 - RNA, 19 nt, Homo sapiens
aauuccauguggacuuaga

SEQ ID NO: 1810 - RNA, 19 nt, Homo sapiens
ucuaaguccacauggaauu

SEQ ID NO: 1811 - RNA, 19 nt, Homo sapiens
auuccauguggacuuagag

SEQ ID NO: 1812 - RNA, 19 nt, Homo sapiens
cucuaaguccacauggaau

SEQ ID NO: 1813 - RNA, 19 nt, Homo sapiens
uuccauguggacuuagagc

SEQ ID NO: 1814 - RNA, 19 nt, Homo sapiens
gcucuaaguccacauggaa

SEQ ID NO: 1815 - RNA, 19 nt, Homo sapiens
ggagcuggcagaccuccau

SEQ ID NO: 1816 - RNA, 19 nt, Homo sapiens
auggaggucugccagcucc

SEQ ID NO: 1817 - RNA, 19 nt, Homo sapiens
gagcuggcagaccuccaug

SEQ ID NO: 1818 - RNA, 19 nt, Homo sapiens
cauggaggucugccagcuc

SEQ ID NO: 1819 - RNA, 19 nt, Homo sapiens
agcuggcagaccuccaugg

SEQ ID NO: 1820 - RNA, 19 nt, Homo sapiens
ccauggaggucugccagcu

SEQ ID NO: 1821 - RNA, 19 nt, Homo sapiens
gcuggcagaccuccauggg

SEQ ID NO: 1822 - RNA, 19 nt, Homo sapiens
cccauggaggucugccagc

SEQ ID NO: 1823 - RNA, 19 nt, Homo sapiens
cuggcagaccuccauggga

SEQ ID NO: 1824 - RNA, 19 nt, Homo sapiens
ucccauggaggucugccag

SEQ ID NO: 1825 - RNA, 19 nt, Homo sapiens
uggcagaccuccaugggaa

SEQ ID NO: 1826 - RNA, 19 nt, Homo sapiens
uucccauggaggucugcca

SEQ ID NO: 1827 - RNA, 19 nt, Homo sapiens
ggcagaccuccaugggaaa

SEQ ID NO: 1828 - RNA, 19 nt, Homo sapiens
uuucccauggaggucugcc

SEQ ID NO: 1829 - RNA, 19 nt, Homo sapiens
gcagaccuccaugggaaag

SEQ ID NO: 1830 - RNA, 19 nt, Homo sapiens
cuuucccauggaggucugc

SEQ ID NO: 1831 - RNA, 19 nt, Homo sapiens
cagaccuccaugggaaaga

SEQ ID NO: 1832 - RNA, 19 nt, Homo sapiens
ucuuucccauggaggucug

SEQ ID NO: 1833 - RNA, 19 nt, Homo sapiens
agaccuccaugggaaagau

SEQ ID NO: 1834 - RNA, 19 nt, Homo sapiens
aucuuucccauggaggucu

SEQ ID NO: 1835 - RNA, 19 nt, Homo sapiens
gaccuccaugggaaagaug

SEQ ID NO: 1836 - RNA, 19 nt, Homo sapiens
caucuuucccauggagguc

SEQ ID NO: 1837 - RNA, 19 nt, Homo sapiens
accuccaugggaaagaugc

SEQ ID NO: 1838 - RNA, 19 nt, Homo sapiens
gcaucuuucccauggaggu

SEQ ID NO: 1839 - RNA, 19 nt, Homo sapiens
cacucuuguuuuccucgug

SEQ ID NO: 1840 - RNA, 19 nt, Homo sapiens
cacgaggaaaacaagagug

SEQ ID NO: 1841 - RNA, 19 nt, Homo sapiens
acucuuguuuuccucgugc

SEQ ID NO: 1842 - RNA, 19 nt, Homo sapiens
gcacgaggaaaacaagagu

SEQ ID NO: 1843 - RNA, 19 nt, Homo sapiens
cucuuguuuuccucgugcu

SEQ ID NO: 1844 - RNA, 19 nt, Homo sapiens
agcacgaggaaaacaagag

SEQ ID NO: 1845 - RNA, 19 nt, Homo sapiens
ucuuguuuuccucgugcuu

SEQ ID NO: 1846 - RNA, 19 nt, Homo sapiens
aagcacgaggaaaacaaga

SEQ ID NO: 1847 - RNA, 19 nt, Homo sapiens
uuguuuuccucgugcuuug

SEQ ID NO: 1848 - RNA, 19 nt, Homo sapiens
caaagcacgaggaaaacaa

SEQ ID NO: 1849 - RNA, 19 nt, Homo sapiens
uguuuuccucgugcuuugu

SEQ ID NO: 1850 - RNA, 19 nt, Homo sapiens
acaaagcacgaggaaaaca

SEQ ID NO: 1851 - RNA, 19 nt, Homo sapiens
guuuuccucgugcuuugug

SEQ ID NO: 1852 - RNA, 19 nt, Homo sapiens
cacaaagcacgaggaaaac

SEQ ID NO: 1853 - RNA, 19 nt, Homo sapiens
uuuuccucgugcuuugugg

SEQ ID NO: 1854 - RNA, 19 nt, Homo sapiens
ccacaaagcacgaggaaaa

SEQ ID NO: 1855 - RNA, 19 nt, Homo sapiens
uuuccucgugcuuuguggc

SEQ ID NO: 1856 - RNA, 19 nt, Homo sapiens
gccacaaagcacgaggaaa

SEQ ID NO: 1857 - RNA, 19 nt, Homo sapiens
uuccucgugcuuuguggcc

SEQ ID NO: 1858 - RNA, 19 nt, Homo sapiens
ggccacaaagcacgaggaa

SEQ ID NO: 1859 - RNA, 19 nt, Homo sapiens
uccucgugcuuuguggcca

SEQ ID NO: 1860 - RNA, 19 nt, Homo sapiens
uggccacaaagcacgagga

SEQ ID NO: 1861 - RNA, 19 nt, Homo sapiens
ccucgugcuuuguggccaa

SEQ ID NO: 1862 - RNA, 19 nt, Homo sapiens
uuggccacaaagcacgagg

SEQ ID NO: 1863 - RNA, 19 nt, Homo sapiens
cucgugcuuuguggccaau

SEQ ID NO: 1864 - RNA, 19 nt, Homo sapiens
auuggccacaaagcacgag

SEQ ID NO: 1865 - RNA, 19 nt, Homo sapiens
ucgugcuuuguggccaaug

SEQ ID NO: 1866 - RNA, 19 nt, Homo sapiens
cauuggccacaaagcacga

SEQ ID NO: 1867 - RNA, 19 nt, Homo sapiens
cgugcuuuguggccaauga

SEQ ID NO: 1868 - RNA, 19 nt, Homo sapiens
ucauuggccacaaagcacg

SEQ ID NO: 1869 - RNA, 19 nt, Homo sapiens
gugcuuuguggccaaugac

SEQ ID NO: 1870 - RNA, 19 nt, Homo sapiens
gucauuggccacaaagcac

SEQ ID NO: 1871 - RNA, 19 nt, Homo sapiens
ugcuuuguggccaaugacu

SEQ ID NO: 1872 - RNA, 19 nt, Homo sapiens
agucauuggccacaaagca

SEQ ID NO: 1873 - RNA, 19 nt, Homo sapiens
gcuuuguggccaaugacuc

SEQ ID NO: 1874 - RNA, 19 nt, Homo sapiens
gagucauuggccacaaagc

SEQ ID NO: 1875 - RNA, 19 nt, Homo sapiens
cuuuguggccaaugacuca

SEQ ID NO: 1876 - RNA, 19 nt, Homo sapiens
ugagucauuggccacaaag

SEQ ID NO: 1877 - RNA, 19 nt, Homo sapiens
uuuguggccaaugacucaa

SEQ ID NO: 1878 - RNA, 19 nt, Homo sapiens
uugagucauuggccacaaa

SEQ ID NO: 1879 - RNA, 19 nt, Homo sapiens
uuguggccaaugacucaac

SEQ ID NO: 1880 - RNA, 19 nt, Homo sapiens
guugagucauuggccacaa

SEQ ID NO: 1881 - RNA, 19 nt, Homo sapiens
uguggccaaugacucaacc

SEQ ID NO: 1882 - RNA, 19 nt, Homo sapiens
gguugagucauuggccaca

SEQ ID NO: 1883 - RNA, 19 nt, Homo sapiens
guggccaaugacucaaccc

SEQ ID NO: 1884 - RNA, 19 nt, Homo sapiens
ggguugagucauuggccac

SEQ ID NO: 1885 - RNA, 19 nt, Homo sapiens
uggccaaugacucaacccu

SEQ ID NO: 1886 - RNA, 19 nt, Homo sapiens
aggguugagucauuggcca

SEQ ID NO: 1887 - RNA, 19 nt, Homo sapiens
ggccaaugacucaacccuc

SEQ ID NO: 1888 - RNA, 19 nt, Homo sapiens
gaggguugagucauuggcc

SEQ ID NO: 1889 - RNA, 19 nt, Homo sapiens
gccaaugacucaacccucu

SEQ ID NO: 1890 - RNA, 19 nt, Homo sapiens
agaggguugagucauuggc

SEQ ID NO: 1891 - RNA, 19 nt, Homo sapiens
ccaaugacucaacccucuu

SEQ ID NO: 1892 - RNA, 19 nt, Homo sapiens
aagaggguugagucauugg

SEQ ID NO: 1893 - RNA, 19 nt, Homo sapiens
caaugacucaacccucuuc

SEQ ID NO: 1894 - RNA, 19 nt, Homo sapiens
gaagaggguugagucauug

SEQ ID NO: 1895 - RNA, 19 nt, Homo sapiens
aaugacucaacccucuuca

SEQ ID NO: 1896 - RNA, 19 nt, Homo sapiens
ugaagaggguugagucauu

SEQ ID NO: 1897 - RNA, 19 nt, Homo sapiens
augacucaacccucuucac

SEQ ID NO: 1898 - RNA, 19 nt, Homo sapiens
gugaagaggguugagucau

SEQ ID NO: 1899 - RNA, 19 nt, Homo sapiens
ugacucaacccucuucacc

SEQ ID NO: 1900 - RNA, 19 nt, Homo sapiens
ggugaagaggguugaguca

SEQ ID NO: 1901 - RNA, 19 nt, Homo sapiens
gacucaacccucuucaccc

SEQ ID NO: 1902 - RNA, 19 nt, Homo sapiens
gggugaagaggguugaguc

SEQ ID NO: 1903 - RNA, 19 nt, Homo sapiens
acucaacccucuucacccu

SEQ ID NO: 1904 - RNA, 19 nt, Homo sapiens
agggugaagaggguugagu

SEQ ID NO: 1905 - RNA, 19 nt, Homo sapiens
cucaacccucuucacccug

SEQ ID NO: 1906 - RNA, 19 nt, Homo sapiens
cagggugaagaggguugag

SEQ ID NO: 1907 - RNA, 19 nt, Homo sapiens
ucaacccucuucacccugg

SEQ ID NO: 1908 - RNA, 19 nt, Homo sapiens
ccagggugaagaggguuga

SEQ ID NO: 1909 - RNA, 19 nt, Homo sapiens
caacccucuucacccuggc

SEQ ID NO: 1910 - RNA, 19 nt, Homo sapiens
gccagggugaagaggguug

SEQ ID NO: 1911 - RNA, 19 nt, Homo sapiens
aacccucuucacccuggcu

SEQ ID NO: 1912 - RNA, 19 nt, Homo sapiens
agccagggugaagaggguu

SEQ ID NO: 1913 - RNA, 19 nt, Homo sapiens
acccucuucacccuggcua

SEQ ID NO: 1914 - RNA, 19 nt, Homo sapiens
uagccagggugaagagggu

SEQ ID NO: 1915 - RNA, 19 nt, Homo sapiens
cccucuucacccuggcuaa

SEQ ID NO: 1916 - RNA, 19 nt, Homo sapiens
uuagccagggugaagaggg

SEQ ID NO: 1917 - RNA, 19 nt, Homo sapiens
ccucuucacccuggcuaag

SEQ ID NO: 1918 - RNA, 19 nt, Homo sapiens
cuuagccagggugaagagg

SEQ ID NO: 1919 - RNA, 19 nt, Homo sapiens
cuucacccuggcuaagaug

SEQ ID NO: 1920 - RNA, 19 nt, Homo sapiens
caucuuagccagggugaag

SEQ ID NO: 1921 - RNA, 19 nt, Homo sapiens
uucacccuggcuaagauga

SEQ ID NO: 1922 - RNA, 19 nt, Homo sapiens
ucaucuuagccagggugaa

SEQ ID NO: 1923 - RNA, 19 nt, Homo sapiens
cacccuggcuaagaugaug

SEQ ID NO: 1924 - RNA, 19 nt, Homo sapiens
caucaucuuagccagggug

SEQ ID NO: 1925 - RNA, 19 nt, Homo sapiens
acccuggcuaagaugaugc

SEQ ID NO: 1926 - RNA, 19 nt, Homo sapiens
gcaucaucuuagccagggu

SEQ ID NO: 1927 - RNA, 19 nt, Homo sapiens
cccuggcuaagaugaugcc

SEQ ID NO: 1928 - RNA, 19 nt, Homo sapiens
ggcaucaucuuagccaggg

SEQ ID NO: 1929 - RNA, 19 nt, Homo sapiens
ccuggcuaagaugaugcca

SEQ ID NO: 1930 - RNA, 19 nt, Homo sapiens
uggcaucaucuuagccagg

SEQ ID NO: 1931 - RNA, 19 nt, Homo sapiens
cuggcuaagaugaugccag

SEQ ID NO: 1932 - RNA, 19 nt, Homo sapiens
cuggcaucaucuuagccag

SEQ ID NO: 1933 - RNA, 19 nt, Homo sapiens
uggcuaagaugaugccagg

SEQ ID NO: 1934 - RNA, 19 nt, Homo sapiens
ccuggcaucaucuuagcca

SEQ ID NO: 1935 - RNA, 19 nt, Homo sapiens
ggcuaagaugaugccaggc

SEQ ID NO: 1936 - RNA, 19 nt, Homo sapiens
gccuggcaucaucuuagcc

SEQ ID NO: 1937 - RNA, 19 nt, Homo sapiens
gcuaagaugaugccaggcu

SEQ ID NO: 1938 - RNA, 19 nt, Homo sapiens
agccuggcaucaucuuagc

SEQ ID NO: 1939 - RNA, 19 nt, Homo sapiens
cuaagaugaugccaggcug

SEQ ID NO: 1940 - RNA, 19 nt, Homo sapiens
cagccuggcaucaucuuag

SEQ ID NO: 1941 - RNA, 19 nt, Homo sapiens
uaagaugaugccaggcugu

SEQ ID NO: 1942 - RNA, 19 nt, Homo sapiens
acagccuggcaucaucuua

SEQ ID NO: 1943 - RNA, 19 nt, Homo sapiens
aagaugaugccaggcugug

SEQ ID NO: 1944 - RNA, 19 nt, Homo sapiens
cacagccuggcaucaucuu

SEQ ID NO: 1945 - RNA, 19 nt, Homo sapiens
agaugaugccaggcuguga

SEQ ID NO: 1946 - RNA, 19 nt, Homo sapiens
ucacagccuggcaucaucu

SEQ ID NO: 1947 - RNA, 19 nt, Homo sapiens
gaugaugccaggcugugag

SEQ ID NO: 1948 - RNA, 19 nt, Homo sapiens
cucacagccuggcaucauc

SEQ ID NO: 1949 - RNA, 19 nt, Homo sapiens
augaugccaggcugugaga

SEQ ID NO: 1950 - RNA, 19 nt, Homo sapiens
ucucacagccuggcaucau

SEQ ID NO: 1951 - RNA, 19 nt, Homo sapiens
ugaugccaggcugugagau

SEQ ID NO: 1952 - RNA, 19 nt, Homo sapiens
aucucacagccuggcauca

SEQ ID NO: 1953 - RNA, 19 nt, Homo sapiens
augccaggcugugagauuu

SEQ ID NO: 1954 - RNA, 19 nt, Homo sapiens
aaaucucacagccuggcau

SEQ ID NO: 1955 - RNA, 19 nt, Homo sapiens
ugccaggcugugagauuua

SEQ ID NO: 1956 - RNA, 19 nt, Homo sapiens
uaaaucucacagccuggca

SEQ ID NO: 1957 - RNA, 19 nt, Homo sapiens
gccaggcugugagauuuac

SEQ ID NO: 1958 - RNA, 19 nt, Homo sapiens
guaaaucucacagccuggc

SEQ ID NO: 1959 - RNA, 19 nt, Homo sapiens
ccaggcugugagauuuacu

SEQ ID NO: 1960 - RNA, 19 nt, Homo sapiens
aguaaaucucacagccugg

SEQ ID NO: 1961 - RNA, 19 nt, Homo sapiens
caggcugugagauuuacuc

SEQ ID NO: 1962 - RNA, 19 nt, Homo sapiens
gaguaaaucucacagccug

SEQ ID NO: 1963 - RNA, 19 nt, Homo sapiens
aggcugugagauuuacucu

SEQ ID NO: 1964 - RNA, 19 nt, Homo sapiens
agaguaaaucucacagccu

SEQ ID NO: 1965 - RNA, 19 nt, Homo sapiens
ggcugugagauuuacucug

SEQ ID NO: 1966 - RNA, 19 nt, Homo sapiens
cagaguaaaucucacagcc

SEQ ID NO: 1967 - RNA, 19 nt, Homo sapiens
gcugugagauuuacucuga

SEQ ID NO: 1968 - RNA, 19 nt, Homo sapiens
ucagaguaaaucucacagc

SEQ ID NO: 1969 - RNA, 19 nt, Homo sapiens
gugagauuuacucugauuc

SEQ ID NO: 1970 - RNA, 19 nt, Homo sapiens
gaaucagaguaaaucucac

SEQ ID NO: 1971 - RNA, 19 nt, Homo sapiens
ugagauuuacucugauucu

SEQ ID NO: 1972 - RNA, 19 nt, Homo sapiens
agaaucagaguaaaucuca

SEQ ID NO: 1973 - RNA, 19 nt, Homo sapiens
gagauuuacucugauucug

SEQ ID NO: 1974 - RNA, 19 nt, Homo sapiens
cagaaucagaguaaaucuc

SEQ ID NO: 1975 - RNA, 19 nt, Homo sapiens
agauuuacucugauucugg

SEQ ID NO: 1976 - RNA, 19 nt, Homo sapiens
ccagaaucagaguaaaucu

SEQ ID NO: 1977 - RNA, 19 nt, Homo sapiens
gauuuacucugauucuggg

SEQ ID NO: 1978 - RNA, 19 nt, Homo sapiens
cccagaaucagaguaaauc

SEQ ID NO: 1979 - RNA, 19 nt, Homo sapiens
auuuacucugauucuggga

SEQ ID NO: 1980 - RNA, 19 nt, Homo sapiens
ucccagaaucagaguaaau

SEQ ID NO: 1981 - RNA, 19 nt, Homo sapiens
uuuacucugauucugggaa

SEQ ID NO: 1982 - RNA, 19 nt, Homo sapiens
uucccagaaucagaguaaa

SEQ ID NO: 1983 - RNA, 19 nt, Homo sapiens
uuacucugauucugggaac

SEQ ID NO: 1984 - RNA, 19 nt, Homo sapiens
guucccagaaucagaguaa

SEQ ID NO: 1985 - RNA, 19 nt, Homo sapiens
uacucugauucugggaacc

SEQ ID NO: 1986 - RNA, 19 nt, Homo sapiens
gguucccagaaucagagua

SEQ ID NO: 1987 - RNA, 19 nt, Homo sapiens
acucugauucugggaacca

SEQ ID NO: 1988 - RNA, 19 nt, Homo sapiens
ugguucccagaaucagagu

SEQ ID NO: 1989 - RNA, 19 nt, Homo sapiens
cucugauucugggaaccau

SEQ ID NO: 1990 - RNA, 19 nt, Homo sapiens
augguucccagaaucagag

SEQ ID NO: 1991 - RNA, 19 nt, Homo sapiens
ucugauucugggaaccaug

SEQ ID NO: 1992 - RNA, 19 nt, Homo sapiens
caugguucccagaaucaga

SEQ ID NO: 1993 - RNA, 19 nt, Homo sapiens
cugauucugggaaccaugc

SEQ ID NO: 1994 - RNA, 19 nt, Homo sapiens
gcaugguucccagaaucag

SEQ ID NO: 1995 - RNA, 19 nt, Homo sapiens
ugauucugggaaccaugcc

SEQ ID NO: 1996 - RNA, 19 nt, Homo sapiens
ggcaugguucccagaauca

SEQ ID NO: 1997 - RNA, 19 nt, Homo sapiens
gauucugggaaccaugccu

SEQ ID NO: 1998 - RNA, 19 nt, Homo sapiens
aggcaugguucccagaauc

SEQ ID NO: 1999 - RNA, 19 nt, Homo sapiens
auucugggaaccaugccuc

SEQ ID NO: 2000 - RNA, 19 nt, Homo sapiens
gaggcaugguucccagaau

SEQ ID NO: 2001 - RNA, 19 nt, Homo sapiens
uucugggaaccaugccucc

SEQ ID NO: 2002 - RNA, 19 nt, Homo sapiens
ggaggcaugguucccagaa

SEQ ID NO: 2003 - RNA, 19 nt, Homo sapiens
ucugggaaccaugccucca

SEQ ID NO: 2004 - RNA, 19 nt, Homo sapiens
uggaggcaugguucccaga

SEQ ID NO: 2005 - RNA, 19 nt, Homo sapiens
cugggaaccaugccuccau

SEQ ID NO: 2006 - RNA, 19 nt, Homo sapiens
auggaggcaugguucccag

SEQ ID NO: 2007 - RNA, 19 nt, Homo sapiens
ugggaaccaugccuccaug

SEQ ID NO: 2008 - RNA, 19 nt, Homo sapiens
cauggaggcaugguuccca

SEQ ID NO: 2009 - RNA, 19 nt, Homo sapiens
gggaaccaugccuccauga

SEQ ID NO: 2010 - RNA, 19 nt, Homo sapiens
ucauggaggcaugguuccc

SEQ ID NO: 2011 - RNA, 19 nt, Homo sapiens
gaaccaugccuccaugauc

SEQ ID NO: 2012 - RNA, 19 nt, Homo sapiens
gaucauggaggcaugguuc

SEQ ID NO: 2013 - RNA, 19 nt, Homo sapiens
aaccaugccuccaugaucc

SEQ ID NO: 2014 - RNA, 19 nt, Homo sapiens
ggaucauggaggcaugguu

SEQ ID NO: 2015 - RNA, 19 nt, Homo sapiens
accaugccuccaugaucca

SEQ ID NO: 2016 - RNA, 19 nt, Homo sapiens
uggaucauggaggcauggu

SEQ ID NO: 2017 - RNA, 19 nt, Homo sapiens
ccaugccuccaugauccaa

SEQ ID NO: 2018 - RNA, 19 nt, Homo sapiens
uuggaucauggaggcaugg

SEQ ID NO: 2019 - RNA, 19 nt, Homo sapiens
caugccuccaugauccaag

SEQ ID NO: 2020 - RNA, 19 nt, Homo sapiens
cuuggaucauggaggcaug

SEQ ID NO: 2021 - RNA, 19 nt, Homo sapiens
augccuccaugauccaagg

SEQ ID NO: 2022 - RNA, 19 nt, Homo sapiens
ccuuggaucauggaggcau

SEQ ID NO: 2023 - RNA, 19 nt, Homo sapiens
ugccuccaugauccaaggg

SEQ ID NO: 2024 - RNA, 19 nt, Homo sapiens
cccuuggaucauggaggca

SEQ ID NO: 2025 - RNA, 19 nt, Homo sapiens
uccaugauccaagggauuc

SEQ ID NO: 2026 - RNA, 19 nt, Homo sapiens
gaaucccuuggaucaugga

SEQ ID NO: 2027 - RNA, 19 nt, Homo sapiens
ccaugauccaagggauucg

SEQ ID NO: 2028 - RNA, 19 nt, Homo sapiens
cgaaucccuuggaucaugg

SEQ ID NO: 2029 - RNA, 19 nt, Homo sapiens
caugauccaagggauucga

SEQ ID NO: 2030 - RNA, 19 nt, Homo sapiens
ucgaaucccuuggaucaug

SEQ ID NO: 2031 - RNA, 19 nt, Homo sapiens
augauccaagggauucgaa

SEQ ID NO: 2032 - RNA, 19 nt, Homo sapiens
uucgaaucccuuggaucau

SEQ ID NO: 2033 - RNA, 19 nt, Homo sapiens
ugauccaagggauucgaaa

SEQ ID NO: 2034 - RNA, 19 nt, Homo sapiens
uuucgaaucccuuggauca

SEQ ID NO: 2035 - RNA, 19 nt, Homo sapiens
gauccaagggauucgaaac

SEQ ID NO: 2036 - RNA, 19 nt, Homo sapiens
guuucgaaucccuuggauc

SEQ ID NO: 2037 - RNA, 19 nt, Homo sapiens
uccaagggauucgaaacag

SEQ ID NO: 2038 - RNA, 19 nt, Homo sapiens
cuguuucgaaucccuugga

SEQ ID NO: 2039 - RNA, 19 nt, Homo sapiens
ccaagggauucgaaacagc

SEQ ID NO: 2040 - RNA, 19 nt, Homo sapiens
gcuguuucgaaucccuugg

SEQ ID NO: 2041 - RNA, 19 nt, Homo sapiens
caagggauucgaaacagcc

SEQ ID NO: 2042 - RNA, 19 nt, Homo sapiens
ggcuguuucgaaucccuug

SEQ ID NO: 2043 - RNA, 19 nt, Homo sapiens
aagggauucgaaacagccg

SEQ ID NO: 2044 - RNA, 19 nt, Homo sapiens
cggcuguuucgaaucccuu

SEQ ID NO: 2045 - RNA, 19 nt, Homo sapiens
agggauucgaaacagccga

SEQ ID NO: 2046 - RNA, 19 nt, Homo sapiens
ucggcuguuucgaaucccu

SEQ ID NO: 2047 - RNA, 19 nt, Homo sapiens
gggauucgaaacagccgag

SEQ ID NO: 2048 - RNA, 19 nt, Homo sapiens
cucggcuguuucgaauccc

SEQ ID NO: 2049 - RNA, 19 nt, Homo sapiens
ggauucgaaacagccgagu

SEQ ID NO: 2050 - RNA, 19 nt, Homo sapiens
acucggcuguuucgaaucc

SEQ ID NO: 2051 - RNA, 19 nt, Homo sapiens
gauucgaaacagccgagug

SEQ ID NO: 2052 - RNA, 19 nt, Homo sapiens
cacucggcuguuucgaauc

SEQ ID NO: 2053 - RNA, 19 nt, Homo sapiens
auucgaaacagccgagugc

SEQ ID NO: 2054 - RNA, 19 nt, Homo sapiens
gcacucggcuguuucgaau

SEQ ID NO: 2055 - RNA, 19 nt, Homo sapiens
uucgaaacagccgagugcc

SEQ ID NO: 2056 - RNA, 19 nt, Homo sapiens
ggcacucggcuguuucgaa

SEQ ID NO: 2057 - RNA, 19 nt, Homo sapiens
ucgaaacagccgagugcca

SEQ ID NO: 2058 - RNA, 19 nt, Homo sapiens
uggcacucggcuguuucga

SEQ ID NO: 2059 - RNA, 19 nt, Homo sapiens
cgaaacagccgagugccaa

SEQ ID NO: 2060 - RNA, 19 nt, Homo sapiens
uuggcacucggcuguuucg

SEQ ID NO: 2061 - RNA, 19 nt, Homo sapiens
gaaacagccgagugccaaa

SEQ ID NO: 2062 - RNA, 19 nt, Homo sapiens
uuuggcacucggcuguuuc

SEQ ID NO: 2063 - RNA, 19 nt, Homo sapiens
aaacagccgagugccaaag

SEQ ID NO: 2064 - RNA, 19 nt, Homo sapiens
cuuuggcacucggcuguuu

SEQ ID NO: 2065 - RNA, 19 nt, Homo sapiens
aacagccgagugccaaagu

SEQ ID NO: 2066 - RNA, 19 nt, Homo sapiens
acuuuggcacucggcuguu

SEQ ID NO: 2067 - RNA, 19 nt, Homo sapiens
acagccgagugccaaagua

SEQ ID NO: 2068 - RNA, 19 nt, Homo sapiens
uacuuuggcacucggcugu

SEQ ID NO: 2069 - RNA, 19 nt, Homo sapiens
cagccgagugccaaaguac

SEQ ID NO: 2070 - RNA, 19 nt, Homo sapiens
guacuuuggcacucggcug

SEQ ID NO: 2071 - RNA, 19 nt, Homo sapiens
gccgagugccaaaguacau

SEQ ID NO: 2072 - RNA, 19 nt, Homo sapiens
auguacuuuggcacucggc

SEQ ID NO: 2073 - RNA, 19 nt, Homo sapiens
ccgagugccaaaguacauc

SEQ ID NO: 2074 - RNA, 19 nt, Homo sapiens
gauguacuuuggcacucgg

SEQ ID NO: 2075 - RNA, 19 nt, Homo sapiens
cgagugccaaaguacaucu

SEQ ID NO: 2076 - RNA, 19 nt, Homo sapiens
agauguacuuuggcacucg

SEQ ID NO: 2077 - RNA, 19 nt, Homo sapiens
gagugccaaaguacaucuu

SEQ ID NO: 2078 - RNA, 19 nt, Homo sapiens
aagauguacuuuggcacuc

SEQ ID NO: 2079 - RNA, 19 nt, Homo sapiens
agugccaaaguacaucuuc

SEQ ID NO: 2080 - RNA, 19 nt, Homo sapiens
gaagauguacuuuggcacu

SEQ ID NO: 2081 - RNA, 19 nt, Homo sapiens
gugccaaaguacaucuucc

SEQ ID NO: 2082 - RNA, 19 nt, Homo sapiens
ggaagauguacuuuggcac

SEQ ID NO: 2083 - RNA, 19 nt, Homo sapiens
ugccaaaguacaucuuccg

SEQ ID NO: 2084 - RNA, 19 nt, Homo sapiens
cggaagauguacuuuggca

SEQ ID NO: 2085 - RNA, 19 nt, Homo sapiens
gccaaaguacaucuuccgc

SEQ ID NO: 2086 - RNA, 19 nt, Homo sapiens
gcggaagauguacuuuggc

SEQ ID NO: 2087 - RNA, 19 nt, Homo sapiens
ccaaaguacaucuuccgcc

SEQ ID NO: 2088 - RNA, 19 nt, Homo sapiens
ggcggaagauguacuuugg

SEQ ID NO: 2089 - RNA, 19 nt, Homo sapiens
caaaguacaucuuccgcca

SEQ ID NO: 2090 - RNA, 19 nt, Homo sapiens
uggcggaagauguacuuug

SEQ ID NO: 2091 - RNA, 19 nt, Homo sapiens
aaaguacaucuuccgccac

SEQ ID NO: 2092 - RNA, 19 nt, Homo sapiens
guggcggaagauguacuuu

SEQ ID NO: 2093 - RNA, 19 nt, Homo sapiens
aaguacaucuuccgccaca

SEQ ID NO: 2094 - RNA, 19 nt, Homo sapiens
uguggcggaagauguacuu

SEQ ID NO: 2095 - RNA, 19 nt, Homo sapiens
aguacaucuuccgccacaa

SEQ ID NO: 2096 - RNA, 19 nt, Homo sapiens
uuguggcggaagauguacu

SEQ ID NO: 2097 - RNA, 19 nt, Homo sapiens
guacaucuuccgccacaau

SEQ ID NO: 2098 - RNA, 19 nt, Homo sapiens
auuguggcggaagauguac

SEQ ID NO: 2099 - RNA, 19 nt, Homo sapiens
uacaucuuccgccacaaug

SEQ ID NO: 2100 - RNA, 19 nt, Homo sapiens
cauuguggcggaagaugua

SEQ ID NO: 2101 - RNA, 19 nt, Homo sapiens
acaucuuccgccacaauga

SEQ ID NO: 2102 - RNA, 19 nt, Homo sapiens
ucauuguggcggaagaugu

SEQ ID NO: 2103 - RNA, 19 nt, Homo sapiens
caucuuccgccacaaugau

SEQ ID NO: 2104 - RNA, 19 nt, Homo sapiens
aucauuguggcggaagaug

SEQ ID NO: 2105 - RNA, 19 nt, Homo sapiens
aucuuccgccacaaugaug

SEQ ID NO: 2106 - RNA, 19 nt, Homo sapiens
caucauuguggcggaagau

SEQ ID NO: 2107 - RNA, 19 nt, Homo sapiens
ucuuccgccacaaugaugu

SEQ ID NO: 2108 - RNA, 19 nt, Homo sapiens
acaucauuguggcggaaga

SEQ ID NO: 2109 - RNA, 19 nt, Homo sapiens
cuuccgccacaaugauguc

SEQ ID NO: 2110 - RNA, 19 nt, Homo sapiens
gacaucauuguggcggaag

SEQ ID NO: 2111 - RNA, 19 nt, Homo sapiens
uuccgccacaaugauguca

SEQ ID NO: 2112 - RNA, 19 nt, Homo sapiens
ugacaucauuguggcggaa

SEQ ID NO: 2113 - RNA, 19 nt, Homo sapiens
uccgccacaaugaugucag

SEQ ID NO: 2114 - RNA, 19 nt, Homo sapiens
cugacaucauuguggcgga

SEQ ID NO: 2115 - RNA, 19 nt, Homo sapiens
ccgccacaaugaugucagc

SEQ ID NO: 2116 - RNA, 19 nt, Homo sapiens
gcugacaucauuguggcgg

SEQ ID NO: 2117 - RNA, 19 nt, Homo sapiens
cgccacaaugaugucagcc

SEQ ID NO: 2118 - RNA, 19 nt, Homo sapiens
ggcugacaucauuguggcg

SEQ ID NO: 2119 - RNA, 19 nt, Homo sapiens
gccacaaugaugucagcca

SEQ ID NO: 2120 - RNA, 19 nt, Homo sapiens
uggcugacaucauuguggc

SEQ ID NO: 2121 - RNA, 19 nt, Homo sapiens
cucagagaacugcugcaaa

SEQ ID NO: 2122 - RNA, 19 nt, Homo sapiens
uuugcagcaguucucugag

SEQ ID NO: 2123 - RNA, 19 nt, Homo sapiens
ucagagaacugcugcaaag

SEQ ID NO: 2124 - RNA, 19 nt, Homo sapiens
cuuugcagcaguucucuga

SEQ ID NO: 2125 - RNA, 19 nt, Homo sapiens
cagagaacugcugcaaaga

SEQ ID NO: 2126 - RNA, 19 nt, Homo sapiens
ucuuugcagcaguucucug

SEQ ID NO: 2127 - RNA, 19 nt, Homo sapiens
agagaacugcugcaaagau

SEQ ID NO: 2128 - RNA, 19 nt, Homo sapiens
aucuuugcagcaguucucu

SEQ ID NO: 2129 - RNA, 19 nt, Homo sapiens
gagaacugcugcaaagauc

SEQ ID NO: 2130 - RNA, 19 nt, Homo sapiens
gaucuuugcagcaguucuc

SEQ ID NO: 2131 - RNA, 19 nt, Homo sapiens
agaacugcugcaaagaucu

SEQ ID NO: 2132 - RNA, 19 nt, Homo sapiens
agaucuuugcagcaguucu

SEQ ID NO: 2133 - RNA, 19 nt, Homo sapiens
gaacugcugcaaagaucug

SEQ ID NO: 2134 - RNA, 19 nt, Homo sapiens
cagaucuuugcagcaguuc

SEQ ID NO: 2135 - RNA, 19 nt, Homo sapiens
aacugcugcaaagaucuga

SEQ ID NO: 2136 - RNA, 19 nt, Homo sapiens
ucagaucuuugcagcaguu

SEQ ID NO: 2137 - RNA, 19 nt, Homo sapiens
acugcugcaaagaucugac

SEQ ID NO: 2138 - RNA, 19 nt, Homo sapiens
gucagaucuuugcagcagu

SEQ ID NO: 2139 - RNA, 19 nt, Homo sapiens
cugcugcaaagaucugacc

SEQ ID NO: 2140 - RNA, 19 nt, Homo sapiens
ggucagaucuuugcagcag

SEQ ID NO: 2141 - RNA, 19 nt, Homo sapiens
ugcugcaaagaucugaccc

SEQ ID NO: 2142 - RNA, 19 nt, Homo sapiens
gggucagaucuuugcagca

SEQ ID NO: 2143 - RNA, 19 nt, Homo sapiens
ucaguccccaagauugugg

SEQ ID NO: 2144 - RNA, 19 nt, Homo sapiens
ccacaaucuuggggacuga

SEQ ID NO: 2145 - RNA, 19 nt, Homo sapiens
caguccccaagauuguggc

SEQ ID NO: 2146 - RNA, 19 nt, Homo sapiens
gccacaaucuuggggacug

SEQ ID NO: 2147 - RNA, 19 nt, Homo sapiens
aguccccaagauuguggca

SEQ ID NO: 2148 - RNA, 19 nt, Homo sapiens
ugccacaaucuuggggacu

SEQ ID NO: 2149 - RNA, 19 nt, Homo sapiens
uccccaagauuguggcauu

SEQ ID NO: 2150 - RNA, 19 nt, Homo sapiens
aaugccacaaucuugggga

SEQ ID NO: 2151 - RNA, 19 nt, Homo sapiens
ccccaagauuguggcauuu

SEQ ID NO: 2152 - RNA, 19 nt, Homo sapiens
aaaugccacaaucuugggg

SEQ ID NO: 2153 - RNA, 19 nt, Homo sapiens
cccaagauuguggcauuug

SEQ ID NO: 2154 - RNA, 19 nt, Homo sapiens
caaaugccacaaucuuggg

SEQ ID NO: 2155 - RNA, 19 nt, Homo sapiens
ccaagauuguggcauuuga

SEQ ID NO: 2156 - RNA, 19 nt, Homo sapiens
ucaaaugccacaaucuugg

SEQ ID NO: 2157 - RNA, 19 nt, Homo sapiens
caagauuguggcauuugaa

SEQ ID NO: 2158 - RNA, 19 nt, Homo sapiens
uucaaaugccacaaucuug

SEQ ID NO: 2159 - RNA, 19 nt, Homo sapiens
aagauuguggcauuugaaa

SEQ ID NO: 2160 - RNA, 19 nt, Homo sapiens
uuucaaaugccacaaucuu

SEQ ID NO: 2161 - RNA, 19 nt, Homo sapiens
agauuguggcauuugaaac

SEQ ID NO: 2162 - RNA, 19 nt, Homo sapiens
guuucaaaugccacaaucu

SEQ ID NO: 2163 - RNA, 19 nt, Homo sapiens
gauuguggcauuugaaacu

SEQ ID NO: 2164 - RNA, 19 nt, Homo sapiens
aguuucaaaugccacaauc

SEQ ID NO: 2165 - RNA, 19 nt, Homo sapiens
auuguggcauuugaaacug

SEQ ID NO: 2166 - RNA, 19 nt, Homo sapiens
caguuucaaaugccacaau

SEQ ID NO: 2167 - RNA, 19 nt, Homo sapiens
uuguggcauuugaaacugu

SEQ ID NO: 2168 - RNA, 19 nt, Homo sapiens
acaguuucaaaugccacaa

SEQ ID NO: 2169 - RNA, 19 nt, Homo sapiens
uguggcauuugaaacuguc

SEQ ID NO: 2170 - RNA, 19 nt, Homo sapiens
gacaguuucaaaugccaca

SEQ ID NO: 2171 - RNA, 19 nt, Homo sapiens
guggcauuugaaacugucc

SEQ ID NO: 2172 - RNA, 19 nt, Homo sapiens
ggacaguuucaaaugccac

SEQ ID NO: 2173 - RNA, 19 nt, Homo sapiens
uggcauuugaaacugucca

SEQ ID NO: 2174 - RNA, 19 nt, Homo sapiens
uggacaguuucaaaugcca

SEQ ID NO: 2175 - RNA, 19 nt, Homo sapiens
ggcauuugaaacuguccau

SEQ ID NO: 2176 - RNA, 19 nt, Homo sapiens
auggacaguuucaaaugcc

SEQ ID NO: 2177 - RNA, 19 nt, Homo sapiens
gcauuugaaacuguccauu

SEQ ID NO: 2178 - RNA, 19 nt, Homo sapiens
aauggacaguuucaaaugc

SEQ ID NO: 2179 - RNA, 19 nt, Homo sapiens
cauuugaaacuguccauuc

SEQ ID NO: 2180 - RNA, 19 nt, Homo sapiens
gaauggacaguuucaaaug

SEQ ID NO: 2181 - RNA, 19 nt, Homo sapiens
auuugaaacuguccauuca

SEQ ID NO: 2182 - RNA, 19 nt, Homo sapiens
ugaauggacaguuucaaau

SEQ ID NO: 2183 - RNA, 19 nt, Homo sapiens
uugaaacuguccauucaau

SEQ ID NO: 2184 - RNA, 19 nt, Homo sapiens
auugaauggacaguuucaa

SEQ ID NO: 2185 - RNA, 19 nt, Homo sapiens
ugaaacuguccauucaaug

SEQ ID NO: 2186 - RNA, 19 nt, Homo sapiens
cauugaauggacaguuuca

SEQ ID NO: 2187 - RNA, 19 nt, Homo sapiens
gaaacuguccauucaaugg

SEQ ID NO: 2188 - RNA, 19 nt, Homo sapiens
ccauugaauggacaguuuc

SEQ ID NO: 2189 - RNA, 19 nt, Homo sapiens
aaacuguccauucaaugga

SEQ ID NO: 2190 - RNA, 19 nt, Homo sapiens
uccauugaauggacaguuu

SEQ ID NO: 2191 - RNA, 19 nt, Homo sapiens
aacuguccauucaauggau

SEQ ID NO: 2192 - RNA, 19 nt, Homo sapiens
auccauugaauggacaguu

SEQ ID NO: 2193 - RNA, 19 nt, Homo sapiens
acuguccauucaauggaug

SEQ ID NO: 2194 - RNA, 19 nt, Homo sapiens
cauccauugaauggacagu

SEQ ID NO: 2195 - RNA, 19 nt, Homo sapiens
cuguccauucaauggaugg

SEQ ID NO: 2196 - RNA, 19 nt, Homo sapiens
ccauccauugaauggacag

SEQ ID NO: 2197 - RNA, 19 nt, Homo sapiens
uguccauucaauggauggg

SEQ ID NO: 2198 - RNA, 19 nt, Homo sapiens
cccauccauugaauggaca

SEQ ID NO: 2199 - RNA, 19 nt, Homo sapiens
guccauucaauggaugggg

SEQ ID NO: 2200 - RNA, 19 nt, Homo sapiens
ccccauccauugaauggac

SEQ ID NO: 2201 - RNA, 19 nt, Homo sapiens
uccauucaauggauggggc

SEQ ID NO: 2202 - RNA, 19 nt, Homo sapiens
gccccauccauugaaugga

SEQ ID NO: 2203 - RNA, 19 nt, Homo sapiens
gugugcccacuggaagagc

SEQ ID NO: 2204 - RNA, 19 nt, Homo sapiens
gcucuuccagugggcacac

SEQ ID NO: 2205 - RNA, 19 nt, Homo sapiens
ugugcccacuggaagagcu

SEQ ID NO: 2206 - RNA, 19 nt, Homo sapiens
agcucuuccagugggcaca

SEQ ID NO: 2207 - RNA, 19 nt, Homo sapiens
gugcccacuggaagagcug

SEQ ID NO: 2208 - RNA, 19 nt, Homo sapiens
cagcucuuccagugggcac

SEQ ID NO: 2209 - RNA, 19 nt, Homo sapiens
ugcccacuggaagagcugu

SEQ ID NO: 2210 - RNA, 19 nt, Homo sapiens
acagcucuuccagugggca

SEQ ID NO: 2211 - RNA, 19 nt, Homo sapiens
gcccacuggaagagcugug

SEQ ID NO: 2212 - RNA, 19 nt, Homo sapiens
cacagcucuuccagugggc

SEQ ID NO: 2213 - RNA, 19 nt, Homo sapiens
cccacuggaagagcugugu

SEQ ID NO: 2214 - RNA, 19 nt, Homo sapiens
acacagcucuuccaguggg

SEQ ID NO: 2215 - RNA, 19 nt, Homo sapiens
ccacuggaagagcugugug

SEQ ID NO: 2216 - RNA, 19 nt, Homo sapiens
cacacagcucuuccagugg

SEQ ID NO: 2217 - RNA, 19 nt, Homo sapiens
cacuggaagagcuguguga

SEQ ID NO: 2218 - RNA, 19 nt, Homo sapiens
ucacacagcucuuccagug

SEQ ID NO: 2219 - RNA, 19 nt, Homo sapiens
acuggaagagcugugugau

SEQ ID NO: 2220 - RNA, 19 nt, Homo sapiens
aucacacagcucuuccagu

SEQ ID NO: 2221 - RNA, 19 nt, Homo sapiens
cuggaagagcugugugaug

SEQ ID NO: 2222 - RNA, 19 nt, Homo sapiens
caucacacagcucuuccag

SEQ ID NO: 2223 - RNA, 19 nt, Homo sapiens
uggaagagcugugugaugu

SEQ ID NO: 2224 - RNA, 19 nt, Homo sapiens
acaucacacagcucuucca

SEQ ID NO: 2225 - RNA, 19 nt, Homo sapiens
ggaagagcugugugaugug

SEQ ID NO: 2226 - RNA, 19 nt, Homo sapiens
cacaucacacagcucuucc

SEQ ID NO: 2227 - RNA, 19 nt, Homo sapiens
gaagagcugugugaugugg

SEQ ID NO: 2228 - RNA, 19 nt, Homo sapiens
ccacaucacacagcucuuc

SEQ ID NO: 2229 - RNA, 19 nt, Homo sapiens
aagagcugugugauguggc

SEQ ID NO: 2230 - RNA, 19 nt, Homo sapiens
gccacaucacacagcucuu

SEQ ID NO: 2231 - RNA, 19 nt, Homo sapiens
agagcugugugauguggcc

SEQ ID NO: 2232 - RNA, 19 nt, Homo sapiens
ggccacaucacacagcucu

SEQ ID NO: 2233 - RNA, 19 nt, Homo sapiens
gagcugugugauguggccc

SEQ ID NO: 2234 - RNA, 19 nt, Homo sapiens
gggccacaucacacagcuc

SEQ ID NO: 2235 - RNA, 19 nt, Homo sapiens
agcugugugauguggccca

SEQ ID NO: 2236 - RNA, 19 nt, Homo sapiens
ugggccacaucacacagcu

SEQ ID NO: 2237 - RNA, 19 nt, Homo sapiens
gcugugugauguggcccau

SEQ ID NO: 2238 - RNA, 19 nt, Homo sapiens
augggccacaucacacagc

SEQ ID NO: 2239 - RNA, 19 nt, Homo sapiens
cugugugauguggcccaug

SEQ ID NO: 2240 - RNA, 19 nt, Homo sapiens
caugggccacaucacacag

SEQ ID NO: 2241 - RNA, 19 nt, Homo sapiens
ugugugauguggcccauga

SEQ ID NO: 2242 - RNA, 19 nt, Homo sapiens
ucaugggccacaucacaca

SEQ ID NO: 2243 - RNA, 19 nt, Homo sapiens
gugugauguggcccaugag

SEQ ID NO: 2244 - RNA, 19 nt, Homo sapiens
cucaugggccacaucacac

SEQ ID NO: 2245 - RNA, 19 nt, Homo sapiens
ugugauguggcccaugagu

SEQ ID NO: 2246 - RNA, 19 nt, Homo sapiens
acucaugggccacaucaca

SEQ ID NO: 2247 - RNA, 19 nt, Homo sapiens
gauguggcccaugaguuug

SEQ ID NO: 2248 - RNA, 19 nt, Homo sapiens
caaacucaugggccacauc

SEQ ID NO: 2249 - RNA, 19 nt, Homo sapiens
auguggcccaugaguuugg

SEQ ID NO: 2250 - RNA, 19 nt, Homo sapiens
ccaaacucaugggccacau

SEQ ID NO: 2251 - RNA, 19 nt, Homo sapiens
uguggcccaugaguuugga

SEQ ID NO: 2252 - RNA, 19 nt, Homo sapiens
uccaaacucaugggccaca

SEQ ID NO: 2253 - RNA, 19 nt, Homo sapiens
guggcccaugaguuuggag

SEQ ID NO: 2254 - RNA, 19 nt, Homo sapiens
cuccaaacucaugggccac

SEQ ID NO: 2255 - RNA, 19 nt, Homo sapiens
uggcccaugaguuuggagc

SEQ ID NO: 2256 - RNA, 19 nt, Homo sapiens
gcuccaaacucaugggcca

SEQ ID NO: 2257 - RNA, 19 nt, Homo sapiens
ggcccaugaguuuggagca

SEQ ID NO: 2258 - RNA, 19 nt, Homo sapiens
ugcuccaaacucaugggcc

SEQ ID NO: 2259 - RNA, 19 nt, Homo sapiens
gcccaugaguuuggagcaa

SEQ ID NO: 2260 - RNA, 19 nt, Homo sapiens
uugcuccaaacucaugggc

SEQ ID NO: 2261 - RNA, 19 nt, Homo sapiens
cccaugaguuuggagcaau

SEQ ID NO: 2262 - RNA, 19 nt, Homo sapiens
auugcuccaaacucauggg

SEQ ID NO: 2263 - RNA, 19 nt, Homo sapiens
ccaugaguuuggagcaauc

SEQ ID NO: 2264 - RNA, 19 nt, Homo sapiens
gauugcuccaaacucaugg

SEQ ID NO: 2265 - RNA, 19 nt, Homo sapiens
augaguuuggagcaaucac

SEQ ID NO: 2266 - RNA, 19 nt, Homo sapiens
gugauugcuccaaacucau

SEQ ID NO: 2267 - RNA, 19 nt, Homo sapiens
ugaguuuggagcaaucacc

SEQ ID NO: 2268 - RNA, 19 nt, Homo sapiens
ggugauugcuccaaacuca

SEQ ID NO: 2269 - RNA, 19 nt, Homo sapiens
aguuuggagcaaucaccuu

SEQ ID NO: 2270 - RNA, 19 nt, Homo sapiens
aaggugauugcuccaaacu

SEQ ID NO: 2271 - RNA, 19 nt, Homo sapiens
guuuggagcaaucaccuuc

SEQ ID NO: 2272 - RNA, 19 nt, Homo sapiens
gaaggugauugcuccaaac

SEQ ID NO: 2273 - RNA, 19 nt, Homo sapiens
uuuggagcaaucaccuucg

SEQ ID NO: 2274 - RNA, 19 nt, Homo sapiens
cgaaggugauugcuccaaa

SEQ ID NO: 2275 - RNA, 19 nt, Homo sapiens
uuggagcaaucaccuucgu

SEQ ID NO: 2276 - RNA, 19 nt, Homo sapiens
acgaaggugauugcuccaa

SEQ ID NO: 2277 - RNA, 19 nt, Homo sapiens
uggagcaaucaccuucgug

SEQ ID NO: 2278 - RNA, 19 nt, Homo sapiens
cacgaaggugauugcucca

SEQ ID NO: 2279 - RNA, 19 nt, Homo sapiens
ggagcaaucaccuucgugg

SEQ ID NO: 2280 - RNA, 19 nt, Homo sapiens
ccacgaaggugauugcucc

SEQ ID NO: 2281 - RNA, 19 nt, Homo sapiens
gagcaaucaccuucgugga

SEQ ID NO: 2282 - RNA, 19 nt, Homo sapiens
uccacgaaggugauugcuc

SEQ ID NO: 2283 - RNA, 19 nt, Homo sapiens
agcaaucaccuucguggau

SEQ ID NO: 2284 - RNA, 19 nt, Homo sapiens
auccacgaaggugauugcu

SEQ ID NO: 2285 - RNA, 19 nt, Homo sapiens
gcaaucaccuucguggaug

SEQ ID NO: 2286 - RNA, 19 nt, Homo sapiens
cauccacgaaggugauugc

SEQ ID NO: 2287 - RNA, 19 nt, Homo sapiens
caaucaccuucguggauga

SEQ ID NO: 2288 - RNA, 19 nt, Homo sapiens
ucauccacgaaggugauug

SEQ ID NO: 2289 - RNA, 19 nt, Homo sapiens
aaucaccuucguggaugag

SEQ ID NO: 2290 - RNA, 19 nt, Homo sapiens
cucauccacgaaggugauu

SEQ ID NO: 2291 - RNA, 19 nt, Homo sapiens
aucaccuucguggaugagg

SEQ ID NO: 2292 - RNA, 19 nt, Homo sapiens
ccucauccacgaaggugau

SEQ ID NO: 2293 - RNA, 19 nt, Homo sapiens
ucaccuucguggaugaggu

SEQ ID NO: 2294 - RNA, 19 nt, Homo sapiens
accucauccacgaagguga

SEQ ID NO: 2295 - RNA, 19 nt, Homo sapiens
caccuucguggaugagguc

SEQ ID NO: 2296 - RNA, 19 nt, Homo sapiens
gaccucauccacgaaggug

SEQ ID NO: 2297 - RNA, 19 nt, Homo sapiens
accuucguggaugaggucc

SEQ ID NO: 2298 - RNA, 19 nt, Homo sapiens
ggaccucauccacgaaggu

SEQ ID NO: 2299 - RNA, 19 nt, Homo sapiens
ccuucguggaugaggucca

SEQ ID NO: 2300 - RNA, 19 nt, Homo sapiens
uggaccucauccacgaagg

SEQ ID NO: 2301 - RNA, 19 nt, Homo sapiens
cuucguggaugagguccac

SEQ ID NO: 2302 - RNA, 19 nt, Homo sapiens
guggaccucauccacgaag

SEQ ID NO: 2303 - RNA, 19 nt, Homo sapiens
uucguggaugagguccacg

SEQ ID NO: 2304 - RNA, 19 nt, Homo sapiens
cguggaccucauccacgaa

SEQ ID NO: 2305 - RNA, 19 nt, Homo sapiens
ucguggaugagguccacgc

SEQ ID NO: 2306 - RNA, 19 nt, Homo sapiens
gcguggaccucauccacga

SEQ ID NO: 2307 - RNA, 19 nt, Homo sapiens
cguggaugagguccacgca

SEQ ID NO: 2308 - RNA, 19 nt, Homo sapiens
ugcguggaccucauccacg

SEQ ID NO: 2309 - RNA, 19 nt, Homo sapiens
guggaugagguccacgcag

SEQ ID NO: 2310 - RNA, 19 nt, Homo sapiens
cugcguggaccucauccac

SEQ ID NO: 2311 - RNA, 19 nt, Homo sapiens
uggaugagguccacgcagu

SEQ ID NO: 2312 - RNA, 19 nt, Homo sapiens
acugcguggaccucaucca

SEQ ID NO: 2313 - RNA, 19 nt, Homo sapiens
ggaugagguccacgcagug

SEQ ID NO: 2314 - RNA, 19 nt, Homo sapiens
cacugcguggaccucaucc

SEQ ID NO: 2315 - RNA, 19 nt, Homo sapiens
gaugagguccacgcagugg

SEQ ID NO: 2316 - RNA, 19 nt, Homo sapiens
ccacugcguggaccucauc

SEQ ID NO: 2317 - RNA, 19 nt, Homo sapiens
augagguccacgcaguggg

SEQ ID NO: 2318 - RNA, 19 nt, Homo sapiens
cccacugcguggaccucau

SEQ ID NO: 2319 - RNA, 19 nt, Homo sapiens
ugagguccacgcagugggg

SEQ ID NO: 2320 - RNA, 19 nt, Homo sapiens
ccccacugcguggaccuca

SEQ ID NO: 2321 - RNA, 19 nt, Homo sapiens
gagguccacgcaguggggc

SEQ ID NO: 2322 - RNA, 19 nt, Homo sapiens
gccccacugcguggaccuc

SEQ ID NO: 2323 - RNA, 19 nt, Homo sapiens
agguccacgcaguggggcu

SEQ ID NO: 2324 - RNA, 19 nt, Homo sapiens
agccccacugcguggaccu

SEQ ID NO: 2325 - RNA, 19 nt, Homo sapiens
ggggcucgaggcggaggga

SEQ ID NO: 2326 - RNA, 19 nt, Homo sapiens
ucccuccgccucgagcccc

SEQ ID NO: 2327 - RNA, 19 nt, Homo sapiens
gggcucgaggcggagggau

SEQ ID NO: 2328 - RNA, 19 nt, Homo sapiens
aucccuccgccucgagccc

SEQ ID NO: 2329 - RNA, 19 nt, Homo sapiens
ggcucgaggcggagggauu

SEQ ID NO: 2330 - RNA, 19 nt, Homo sapiens
aaucccuccgccucgagcc

SEQ ID NO: 2331 - RNA, 19 nt, Homo sapiens
gcucgaggcggagggauug

SEQ ID NO: 2332 - RNA, 19 nt, Homo sapiens
caaucccuccgccucgagc

SEQ ID NO: 2333 - RNA, 19 nt, Homo sapiens
cucgaggcggagggauugg

SEQ ID NO: 2334 - RNA, 19 nt, Homo sapiens
ccaaucccuccgccucgag

SEQ ID NO: 2335 - RNA, 19 nt, Homo sapiens
ucgaggcggagggauuggg

SEQ ID NO: 2336 - RNA, 19 nt, Homo sapiens
cccaaucccuccgccucga

SEQ ID NO: 2337 - RNA, 19 nt, Homo sapiens
cgaggcggagggauugggg

SEQ ID NO: 2338 - RNA, 19 nt, Homo sapiens
ccccaaucccuccgccucg

SEQ ID NO: 2339 - RNA, 19 nt, Homo sapiens
gaggcggagggauugggga

SEQ ID NO: 2340 - RNA, 19 nt, Homo sapiens
uccccaaucccuccgccuc

SEQ ID NO: 2341 - RNA, 19 nt, Homo sapiens
aggcggagggauuggggau

SEQ ID NO: 2342 - RNA, 19 nt, Homo sapiens
auccccaaucccuccgccu

SEQ ID NO: 2343 - RNA, 19 nt, Homo sapiens
ggcggagggauuggggauc

SEQ ID NO: 2344 - RNA, 19 nt, Homo sapiens
gauccccaaucccuccgcc

SEQ ID NO: 2345 - RNA, 19 nt, Homo sapiens
gcggagggauuggggaucg

SEQ ID NO: 2346 - RNA, 19 nt, Homo sapiens
cgauccccaaucccuccgc

SEQ ID NO: 2347 - RNA, 19 nt, Homo sapiens
cggagggauuggggaucgg

SEQ ID NO: 2348 - RNA, 19 nt, Homo sapiens
ccgauccccaaucccuccg

SEQ ID NO: 2349 - RNA, 19 nt, Homo sapiens
ggagggauuggggaucggg

SEQ ID NO: 2350 - RNA, 19 nt, Homo sapiens
cccgauccccaaucccucc

SEQ ID NO: 2351 - RNA, 19 nt, Homo sapiens
gagggauuggggaucggga

SEQ ID NO: 2352 - RNA, 19 nt, Homo sapiens
ucccgauccccaaucccuc

SEQ ID NO: 2353 - RNA, 19 nt, Homo sapiens
agggauuggggaucgggau

SEQ ID NO: 2354 - RNA, 19 nt, Homo sapiens
aucccgauccccaaucccu

SEQ ID NO: 2355 - RNA, 19 nt, Homo sapiens
gggauuggggaucgggaug

SEQ ID NO: 2356 - RNA, 19 nt, Homo sapiens
caucccgauccccaauccc

SEQ ID NO: 2357 - RNA, 19 nt, Homo sapiens
ggauuggggaucgggaugg

SEQ ID NO: 2358 - RNA, 19 nt, Homo sapiens
ccaucccgauccccaaucc

SEQ ID NO: 2359 - RNA, 19 nt, Homo sapiens
gauuggggaucgggaugga

SEQ ID NO: 2360 - RNA, 19 nt, Homo sapiens
uccaucccgauccccaauc

SEQ ID NO: 2361 - RNA, 19 nt, Homo sapiens
auuggggaucgggauggag

SEQ ID NO: 2362 - RNA, 19 nt, Homo sapiens
cuccaucccgauccccaau

SEQ ID NO: 2363 - RNA, 19 nt, Homo sapiens
uuggggaucgggauggagu

SEQ ID NO: 2364 - RNA, 19 nt, Homo sapiens
acuccaucccgauccccaa

SEQ ID NO: 2365 - RNA, 19 nt, Homo sapiens
uggggaucgggauggaguc

SEQ ID NO: 2366 - RNA, 19 nt, Homo sapiens
gacuccaucccgaucccca

SEQ ID NO: 2367 - RNA, 19 nt, Homo sapiens
gggaucgggauggagucau

SEQ ID NO: 2368 - RNA, 19 nt, Homo sapiens
augacuccaucccgauccc

SEQ ID NO: 2369 - RNA, 19 nt, Homo sapiens
ggaucgggauggagucaug

SEQ ID NO: 2370 - RNA, 19 nt, Homo sapiens
caugacuccaucccgaucc

SEQ ID NO: 2371 - RNA, 19 nt, Homo sapiens
gaucgggauggagucaugc

SEQ ID NO: 2372 - RNA, 19 nt, Homo sapiens
gcaugacuccaucccgauc

SEQ ID NO: 2373 - RNA, 19 nt, Homo sapiens
aucgggauggagucaugcc

SEQ ID NO: 2374 - RNA, 19 nt, Homo sapiens
ggcaugacuccaucccgau

SEQ ID NO: 2375 - RNA, 19 nt, Homo sapiens
ucgggauggagucaugcca

SEQ ID NO: 2376 - RNA, 19 nt, Homo sapiens
uggcaugacuccaucccga

SEQ ID NO: 2377 - RNA, 19 nt, Homo sapiens
cgggauggagucaugccaa

SEQ ID NO: 2378 - RNA, 19 nt, Homo sapiens
uuggcaugacuccaucccg

SEQ ID NO: 2379 - RNA, 19 nt, Homo sapiens
gggauggagucaugccaaa

SEQ ID NO: 2380 - RNA, 19 nt, Homo sapiens
uuuggcaugacuccauccc

SEQ ID NO: 2381 - RNA, 19 nt, Homo sapiens
ggauggagucaugccaaaa

SEQ ID NO: 2382 - RNA, 19 nt, Homo sapiens
uuuuggcaugacuccaucc

SEQ ID NO: 2383 - RNA, 19 nt, Homo sapiens
gauggagucaugccaaaaa

SEQ ID NO: 2384 - RNA, 19 nt, Homo sapiens
uuuuuggcaugacuccauc

SEQ ID NO: 2385 - RNA, 19 nt, Homo sapiens
auggagucaugccaaaaau

SEQ ID NO: 2386 - RNA, 19 nt, Homo sapiens
auuuuuggcaugacuccau

SEQ ID NO: 2387 - RNA, 19 nt, Homo sapiens
uggagucaugccaaaaaug

SEQ ID NO: 2388 - RNA, 19 nt, Homo sapiens
cauuuuuggcaugacucca

SEQ ID NO: 2389 - RNA, 19 nt, Homo sapiens
ggagucaugccaaaaaugg

SEQ ID NO: 2390 - RNA, 19 nt, Homo sapiens
ccauuuuuggcaugacucc

SEQ ID NO: 2391 - RNA, 19 nt, Homo sapiens
gagucaugccaaaaaugga

SEQ ID NO: 2392 - RNA, 19 nt, Homo sapiens
uccauuuuuggcaugacuc

SEQ ID NO: 2393 - RNA, 19 nt, Homo sapiens
agucaugccaaaaauggac

SEQ ID NO: 2394 - RNA, 19 nt, Homo sapiens
guccauuuuuggcaugacu

SEQ ID NO: 2395 - RNA, 19 nt, Homo sapiens
ucaugccaaaaauggacau

SEQ ID NO: 2396 - RNA, 19 nt, Homo sapiens
auguccauuuuuggcauga

SEQ ID NO: 2397 - RNA, 19 nt, Homo sapiens
caugccaaaaauggacauc

SEQ ID NO: 2398 - RNA, 19 nt, Homo sapiens
gauguccauuuuuggcaug

SEQ ID NO: 2399 - RNA, 19 nt, Homo sapiens
gccaaaaauggacaucauu

SEQ ID NO: 2400 - RNA, 19 nt, Homo sapiens
aaugauguccauuuuuggc

SEQ ID NO: 2401 - RNA, 19 nt, Homo sapiens
caaaaauggacaucauuuc

SEQ ID NO: 2402 - RNA, 19 nt, Homo sapiens
gaaaugauguccauuuuug

SEQ ID NO: 2403 - RNA, 19 nt, Homo sapiens
aaaaauggacaucauuucu

SEQ ID NO: 2404 - RNA, 19 nt, Homo sapiens
agaaaugauguccauuuuu

SEQ ID NO: 2405 - RNA, 19 nt, Homo sapiens
aaaauggacaucauuucug

SEQ ID NO: 2406 - RNA, 19 nt, Homo sapiens
cagaaaugauguccauuuu

SEQ ID NO: 2407 - RNA, 19 nt, Homo sapiens
aaauggacaucauuucugg

SEQ ID NO: 2408 - RNA, 19 nt, Homo sapiens
ccagaaaugauguccauuu

SEQ ID NO: 2409 - RNA, 19 nt, Homo sapiens
aauggacaucauuucugga

SEQ ID NO: 2410 - RNA, 19 nt, Homo sapiens
uccagaaaugauguccauu

SEQ ID NO: 2411 - RNA, 19 nt, Homo sapiens
auggacaucauuucuggaa

SEQ ID NO: 2412 - RNA, 19 nt, Homo sapiens
uuccagaaaugauguccau

SEQ ID NO: 2413 - RNA, 19 nt, Homo sapiens
uggacaucauuucuggaac

SEQ ID NO: 2414 - RNA, 19 nt, Homo sapiens
guuccagaaaugaugucca

SEQ ID NO: 2415 - RNA, 19 nt, Homo sapiens
ggacaucauuucuggaaca

SEQ ID NO: 2416 - RNA, 19 nt, Homo sapiens
uguuccagaaaugaugucc

SEQ ID NO: 2417 - RNA, 19 nt, Homo sapiens
gacaucauuucuggaacac

SEQ ID NO: 2418 - RNA, 19 nt, Homo sapiens
guguuccagaaaugauguc

SEQ ID NO: 2419 - RNA, 19 nt, Homo sapiens
acaucauuucuggaacacu

SEQ ID NO: 2420 - RNA, 19 nt, Homo sapiens
aguguuccagaaaugaugu

SEQ ID NO: 2421 - RNA, 19 nt, Homo sapiens
caucauuucuggaacacuu

SEQ ID NO: 2422 - RNA, 19 nt, Homo sapiens
aaguguuccagaaaugaug

SEQ ID NO: 2423 - RNA, 19 nt, Homo sapiens
aucauuucuggaacacuug

SEQ ID NO: 2424 - RNA, 19 nt, Homo sapiens
caaguguuccagaaaugau

SEQ ID NO: 2425 - RNA, 19 nt, Homo sapiens
ucauuucuggaacacuugg

SEQ ID NO: 2426 - RNA, 19 nt, Homo sapiens
ccaaguguuccagaaauga

SEQ ID NO: 2427 - RNA, 19 nt, Homo sapiens
cauuucuggaacacuuggc

SEQ ID NO: 2428 - RNA, 19 nt, Homo sapiens
gccaaguguuccagaaaug

SEQ ID NO: 2429 - RNA, 19 nt, Homo sapiens
auuucuggaacacuuggca

SEQ ID NO: 2430 - RNA, 19 nt, Homo sapiens
ugccaaguguuccagaaau

SEQ ID NO: 2431 - RNA, 19 nt, Homo sapiens
uuucuggaacacuuggcaa

SEQ ID NO: 2432 - RNA, 19 nt, Homo sapiens
uugccaaguguuccagaaa

SEQ ID NO: 2433 - RNA, 19 nt, Homo sapiens
uucuggaacacuuggcaaa

SEQ ID NO: 2434 - RNA, 19 nt, Homo sapiens
uuugccaaguguuccagaa

SEQ ID NO: 2435 - RNA, 19 nt, Homo sapiens
ucuggaacacuuggcaaag

SEQ ID NO: 2436 - RNA, 19 nt, Homo sapiens
cuuugccaaguguuccaga

SEQ ID NO: 2437 - RNA, 19 nt, Homo sapiens
cuggaacacuuggcaaagc

SEQ ID NO: 2438 - RNA, 19 nt, Homo sapiens
gcuuugccaaguguuccag

SEQ ID NO: 2439 - RNA, 19 nt, Homo sapiens
uggaacacuuggcaaagcc

SEQ ID NO: 2440 - RNA, 19 nt, Homo sapiens
ggcuuugccaaguguucca

SEQ ID NO: 2441 - RNA, 19 nt, Homo sapiens
ggaacacuuggcaaagccu

SEQ ID NO: 2442 - RNA, 19 nt, Homo sapiens
aggcuuugccaaguguucc

SEQ ID NO: 2443 - RNA, 19 nt, Homo sapiens
gaacacuuggcaaagccuu

SEQ ID NO: 2444 - RNA, 19 nt, Homo sapiens
aaggcuuugccaaguguuc

SEQ ID NO: 2445 - RNA, 19 nt, Homo sapiens
aacacuuggcaaagccuuu

SEQ ID NO: 2446 - RNA, 19 nt, Homo sapiens
aaaggcuuugccaaguguu

SEQ ID NO: 2447 - RNA, 19 nt, Homo sapiens
acacuuggcaaagccuuug

SEQ ID NO: 2448 - RNA, 19 nt, Homo sapiens
caaaggcuuugccaagugu

SEQ ID NO: 2449 - RNA, 19 nt, Homo sapiens
cacuuggcaaagccuuugg

SEQ ID NO: 2450 - RNA, 19 nt, Homo sapiens
ccaaaggcuuugccaagug

SEQ ID NO: 2451 - RNA, 19 nt, Homo sapiens
uguguuggaggguacaucg

SEQ ID NO: 2452 - RNA, 19 nt, Homo sapiens
cgauguacccuccaacaca

SEQ ID NO: 2453 - RNA, 19 nt, Homo sapiens
guguuggaggguacaucgc

SEQ ID NO: 2454 - RNA, 19 nt, Homo sapiens
gcgauguacccuccaacac

SEQ ID NO: 2455 - RNA, 19 nt, Homo sapiens
uguuggaggguacaucgcc

SEQ ID NO: 2456 - RNA, 19 nt, Homo sapiens
ggcgauguacccuccaaca

SEQ ID NO: 2457 - RNA, 19 nt, Homo sapiens
guuggaggguacaucgcca

SEQ ID NO: 2458 - RNA, 19 nt, Homo sapiens
uggcgauguacccuccaac

SEQ ID NO: 2459 - RNA, 19 nt, Homo sapiens
uuggaggguacaucgccag

SEQ ID NO: 2460 - RNA, 19 nt, Homo sapiens
cuggcgauguacccuccaa

SEQ ID NO: 2461 - RNA, 19 nt, Homo sapiens
uggaggguacaucgccagc

SEQ ID NO: 2462 - RNA, 19 nt, Homo sapiens
gcuggcgauguacccucca

SEQ ID NO: 2463 - RNA, 19 nt, Homo sapiens
ggaggguacaucgccagca

SEQ ID NO: 2464 - RNA, 19 nt, Homo sapiens
ugcuggcgauguacccucc

SEQ ID NO: 2465 - RNA, 19 nt, Homo sapiens
gaggguacaucgccagcac

SEQ ID NO: 2466 - RNA, 19 nt, Homo sapiens
gugcuggcgauguacccuc

SEQ ID NO: 2467 - RNA, 19 nt, Homo sapiens
aggguacaucgccagcacg

SEQ ID NO: 2468 - RNA, 19 nt, Homo sapiens
cgugcuggcgauguacccu

SEQ ID NO: 2469 - RNA, 19 nt, Homo sapiens
ggguacaucgccagcacga

SEQ ID NO: 2470 - RNA, 19 nt, Homo sapiens
ucgugcuggcgauguaccc

SEQ ID NO: 2471 - RNA, 19 nt, Homo sapiens
gguacaucgccagcacgag

SEQ ID NO: 2472 - RNA, 19 nt, Homo sapiens
cucgugcuggcgauguacc

SEQ ID NO: 2473 - RNA, 19 nt, Homo sapiens
guacaucgccagcacgagu

SEQ ID NO: 2474 - RNA, 19 nt, Homo sapiens
acucgugcuggcgauguac

SEQ ID NO: 2475 - RNA, 19 nt, Homo sapiens
uacaucgccagcacgaguu

SEQ ID NO: 2476 - RNA, 19 nt, Homo sapiens
aacucgugcuggcgaugua

SEQ ID NO: 2477 - RNA, 19 nt, Homo sapiens
acaucgccagcacgaguuc

SEQ ID NO: 2478 - RNA, 19 nt, Homo sapiens
gaacucgugcuggcgaugu

SEQ ID NO: 2479 - RNA, 19 nt, Homo sapiens
caucgccagcacgaguucu

SEQ ID NO: 2480 - RNA, 19 nt, Homo sapiens
agaacucgugcuggcgaug

SEQ ID NO: 2481 - RNA, 19 nt, Homo sapiens
aucgccagcacgaguucuc

SEQ ID NO: 2482 - RNA, 19 nt, Homo sapiens
gagaacucgugcuggcgau

SEQ ID NO: 2483 - RNA, 19 nt, Homo sapiens
ucgccagcacgaguucucu

SEQ ID NO: 2484 - RNA, 19 nt, Homo sapiens
agagaacucgugcuggcga

SEQ ID NO: 2485 - RNA, 19 nt, Homo sapiens
cgccagcacgaguucucug

SEQ ID NO: 2486 - RNA, 19 nt, Homo sapiens
cagagaacucgugcuggcg

SEQ ID NO: 2487 - RNA, 19 nt, Homo sapiens
gccagcacgaguucucuga

SEQ ID NO: 2488 - RNA, 19 nt, Homo sapiens
ucagagaacucgugcuggc

SEQ ID NO: 2489 - RNA, 19 nt, Homo sapiens
ccagcacgaguucucugau

SEQ ID NO: 2490 - RNA, 19 nt, Homo sapiens
aucagagaacucgugcugg

SEQ ID NO: 2491 - RNA, 19 nt, Homo sapiens
cagcacgaguucucugauu

SEQ ID NO: 2492 - RNA, 19 nt, Homo sapiens
aaucagagaacucgugcug

SEQ ID NO: 2493 - RNA, 19 nt, Homo sapiens
agcacgaguucucugauug

SEQ ID NO: 2494 - RNA, 19 nt, Homo sapiens
caaucagagaacucgugcu

SEQ ID NO: 2495 - RNA, 19 nt, Homo sapiens
gcacgaguucucugauuga

SEQ ID NO: 2496 - RNA, 19 nt, Homo sapiens
ucaaucagagaacucgugc

SEQ ID NO: 2497 - RNA, 19 nt, Homo sapiens
cacgaguucucugauugac

SEQ ID NO: 2498 - RNA, 19 nt, Homo sapiens
gucaaucagagaacucgug

SEQ ID NO: 2499 - RNA, 19 nt, Homo sapiens
cgaguucucugauugacac

SEQ ID NO: 2500 - RNA, 19 nt, Homo sapiens
gugucaaucagagaacucg

SEQ ID NO: 2501 - RNA, 19 nt, Homo sapiens
guacgguccuaugcugcug

SEQ ID NO: 2502 - RNA, 19 nt, Homo sapiens
cagcagcauaggaccguac

SEQ ID NO: 2503 - RNA, 19 nt, Homo sapiens
uacgguccuaugcugcugg

SEQ ID NO: 2504 - RNA, 19 nt, Homo sapiens
ccagcagcauaggaccgua

SEQ ID NO: 2505 - RNA, 19 nt, Homo sapiens
acgguccuaugcugcuggc

SEQ ID NO: 2506 - RNA, 19 nt, Homo sapiens
gccagcagcauaggaccgu

SEQ ID NO: 2507 - RNA, 19 nt, Homo sapiens
cgguccuaugcugcuggcu

SEQ ID NO: 2508 - RNA, 19 nt, Homo sapiens
agccagcagcauaggaccg

SEQ ID NO: 2509 - RNA, 19 nt, Homo sapiens
gguccuaugcugcuggcuu

SEQ ID NO: 2510 - RNA, 19 nt, Homo sapiens
aagccagcagcauaggacc

SEQ ID NO: 2511 - RNA, 19 nt, Homo sapiens
guccuaugcugcuggcuuc

SEQ ID NO: 2512 - RNA, 19 nt, Homo sapiens
gaagccagcagcauaggac

SEQ ID NO: 2513 - RNA, 19 nt, Homo sapiens
uccuaugcugcuggcuuca

SEQ ID NO: 2514 - RNA, 19 nt, Homo sapiens
ugaagccagcagcauagga

SEQ ID NO: 2515 - RNA, 19 nt, Homo sapiens
ccuaugcugcuggcuucau

SEQ ID NO: 2516 - RNA, 19 nt, Homo sapiens
augaagccagcagcauagg

SEQ ID NO: 2517 - RNA, 19 nt, Homo sapiens
cuaugcugcuggcuucauc

SEQ ID NO: 2518 - RNA, 19 nt, Homo sapiens
gaugaagccagcagcauag

SEQ ID NO: 2519 - RNA, 19 nt, Homo sapiens
uaugcugcuggcuucaucu

SEQ ID NO: 2520 - RNA, 19 nt, Homo sapiens
agaugaagccagcagcaua

SEQ ID NO: 2521 - RNA, 19 nt, Homo sapiens
augcugcuggcuucaucuu

SEQ ID NO: 2522 - RNA, 19 nt, Homo sapiens
aagaugaagccagcagcau

SEQ ID NO: 2523 - RNA, 19 nt, Homo sapiens
ugcugcuggcuucaucuuc

SEQ ID NO: 2524 - RNA, 19 nt, Homo sapiens
gaagaugaagccagcagca

SEQ ID NO: 2525 - RNA, 19 nt, Homo sapiens
gcugcuggcuucaucuuca

SEQ ID NO: 2526 - RNA, 19 nt, Homo sapiens
ugaagaugaagccagcagc

SEQ ID NO: 2527 - RNA, 19 nt, Homo sapiens
cugcuggcuucaucuucac

SEQ ID NO: 2528 - RNA, 19 nt, Homo sapiens
gugaagaugaagccagcag

SEQ ID NO: 2529 - RNA, 19 nt, Homo sapiens
ugcuggcuucaucuucacc

SEQ ID NO: 2530 - RNA, 19 nt, Homo sapiens
ggugaagaugaagccagca

SEQ ID NO: 2531 - RNA, 19 nt, Homo sapiens
gcuggcuucaucuucacca

SEQ ID NO: 2532 - RNA, 19 nt, Homo sapiens
uggugaagaugaagccagc

SEQ ID NO: 2533 - RNA, 19 nt, Homo sapiens
cuggcuucaucuucaccac

SEQ ID NO: 2534 - RNA, 19 nt, Homo sapiens
guggugaagaugaagccag

SEQ ID NO: 2535 - RNA, 19 nt, Homo sapiens
uggcuucaucuucaccacc

SEQ ID NO: 2536 - RNA, 19 nt, Homo sapiens
gguggugaagaugaagcca

SEQ ID NO: 2537 - RNA, 19 nt, Homo sapiens
ggcuucaucuucaccaccu

SEQ ID NO: 2538 - RNA, 19 nt, Homo sapiens
agguggugaagaugaagcc

SEQ ID NO: 2539 - RNA, 19 nt, Homo sapiens
gcuucaucuucaccaccuc

SEQ ID NO: 2540 - RNA, 19 nt, Homo sapiens
gagguggugaagaugaagc

SEQ ID NO: 2541 - RNA, 19 nt, Homo sapiens
cuucaucuucaccaccucu

SEQ ID NO: 2542 - RNA, 19 nt, Homo sapiens
agagguggugaagaugaag

SEQ ID NO: 2543 - RNA, 19 nt, Homo sapiens
uucaucuucaccaccucuc

SEQ ID NO: 2544 - RNA, 19 nt, Homo sapiens
gagagguggugaagaugaa

SEQ ID NO: 2545 - RNA, 19 nt, Homo sapiens
ucaucuucaccaccucucu

SEQ ID NO: 2546 - RNA, 19 nt, Homo sapiens
agagagguggugaagauga

SEQ ID NO: 2547 - RNA, 19 nt, Homo sapiens
caucuucaccaccucucug

SEQ ID NO: 2548 - RNA, 19 nt, Homo sapiens
cagagagguggugaagaug

SEQ ID NO: 2549 - RNA, 19 nt, Homo sapiens
aucuucaccaccucucugc

SEQ ID NO: 2550 - RNA, 19 nt, Homo sapiens
gcagagagguggugaagau

SEQ ID NO: 2551 - RNA, 19 nt, Homo sapiens
ucuucaccaccucucugcc

SEQ ID NO: 2552 - RNA, 19 nt, Homo sapiens
ggcagagagguggugaaga

SEQ ID NO: 2553 - RNA, 19 nt, Homo sapiens
cuucaccaccucucugcca

SEQ ID NO: 2554 - RNA, 19 nt, Homo sapiens
uggcagagagguggugaag

SEQ ID NO: 2555 - RNA, 19 nt, Homo sapiens
uucaccaccucucugccac

SEQ ID NO: 2556 - RNA, 19 nt, Homo sapiens
guggcagagagguggugaa

SEQ ID NO: 2557 - RNA, 19 nt, Homo sapiens
ucaccaccucucugccacc

SEQ ID NO: 2558 - RNA, 19 nt, Homo sapiens
gguggcagagaggugguga

SEQ ID NO: 2559 - RNA, 19 nt, Homo sapiens
caccaccucucugccaccc

SEQ ID NO: 2560 - RNA, 19 nt, Homo sapiens
ggguggcagagagguggug

SEQ ID NO: 2561 - RNA, 19 nt, Homo sapiens
accaccucucugccaccca

SEQ ID NO: 2562 - RNA, 19 nt, Homo sapiens
uggguggcagagagguggu

SEQ ID NO: 2563 - RNA, 19 nt, Homo sapiens
ccaccucucugccacccau

SEQ ID NO: 2564 - RNA, 19 nt, Homo sapiens
auggguggcagagaggugg

SEQ ID NO: 2565 - RNA, 19 nt, Homo sapiens
caccucucugccacccaug

SEQ ID NO: 2566 - RNA, 19 nt, Homo sapiens
cauggguggcagagaggug

SEQ ID NO: 2567 - RNA, 19 nt, Homo sapiens
accucucugccacccaugc

SEQ ID NO: 2568 - RNA, 19 nt, Homo sapiens
gcauggguggcagagaggu

SEQ ID NO: 2569 - RNA, 19 nt, Homo sapiens
ccucucugccacccaugcu

SEQ ID NO: 2570 - RNA, 19 nt, Homo sapiens
agcauggguggcagagagg

SEQ ID NO: 2571 - RNA, 19 nt, Homo sapiens
cucucugccacccaugcug

SEQ ID NO: 2572 - RNA, 19 nt, Homo sapiens
cagcauggguggcagagag

SEQ ID NO: 2573 - RNA, 19 nt, Homo sapiens
ucucugccacccaugcugc

SEQ ID NO: 2574 - RNA, 19 nt, Homo sapiens
gcagcauggguggcagaga

SEQ ID NO: 2575 - RNA, 19 nt, Homo sapiens
cucugccacccaugcugcu

SEQ ID NO: 2576 - RNA, 19 nt, Homo sapiens
agcagcauggguggcagag

SEQ ID NO: 2577 - RNA, 19 nt, Homo sapiens
ucugccacccaugcugcug

SEQ ID NO: 2578 - RNA, 19 nt, Homo sapiens
cagcagcauggguggcaga

SEQ ID NO: 2579 - RNA, 19 nt, Homo sapiens
cugccacccaugcugcugg

SEQ ID NO: 2580 - RNA, 19 nt, Homo sapiens
ccagcagcauggguggcag

SEQ ID NO: 2581 - RNA, 19 nt, Homo sapiens
ugccacccaugcugcuggc

SEQ ID NO: 2582 - RNA, 19 nt, Homo sapiens
gccagcagcauggguggca

SEQ ID NO: 2583 - RNA, 19 nt, Homo sapiens
gccacccaugcugcuggcu

SEQ ID NO: 2584 - RNA, 19 nt, Homo sapiens
agccagcagcauggguggc

SEQ ID NO: 2585 - RNA, 19 nt, Homo sapiens
ccacccaugcugcuggcug

SEQ ID NO: 2586 - RNA, 19 nt, Homo sapiens
cagccagcagcaugggugg

SEQ ID NO: 2587 - RNA, 19 nt, Homo sapiens
cacccaugcugcuggcugg

SEQ ID NO: 2588 - RNA, 19 nt, Homo sapiens
ccagccagcagcaugggug

SEQ ID NO: 2589 - RNA, 19 nt, Homo sapiens
acccaugcugcuggcugga

SEQ ID NO: 2590 - RNA, 19 nt, Homo sapiens
uccagccagcagcaugggu

SEQ ID NO: 2591 - RNA, 19 nt, Homo sapiens
cccaugcugcuggcuggag

SEQ ID NO: 2592 - RNA, 19 nt, Homo sapiens
cuccagccagcagcauggg

SEQ ID NO: 2593 - RNA, 19 nt, Homo sapiens
ccaugcugcuggcuggagc

SEQ ID NO: 2594 - RNA, 19 nt, Homo sapiens
gcuccagccagcagcaugg

SEQ ID NO: 2595 - RNA, 19 nt, Homo sapiens
caugcugcuggcuggagcc

SEQ ID NO: 2596 - RNA, 19 nt, Homo sapiens
ggcuccagccagcagcaug

SEQ ID NO: 2597 - RNA, 19 nt, Homo sapiens
augcugcuggcuggagccc

SEQ ID NO: 2598 - RNA, 19 nt, Homo sapiens
gggcuccagccagcagcau

SEQ ID NO: 2599 - RNA, 19 nt, Homo sapiens
ugcugcuggcuggagcccu

SEQ ID NO: 2600 - RNA, 19 nt, Homo sapiens
agggcuccagccagcagca

SEQ ID NO: 2601 - RNA, 19 nt, Homo sapiens
gcugcuggcuggagcccug

SEQ ID NO: 2602 - RNA, 19 nt, Homo sapiens
cagggcuccagccagcagc

SEQ ID NO: 2603 - RNA, 19 nt, Homo sapiens
cugcuggcuggagcccugg

SEQ ID NO: 2604 - RNA, 19 nt, Homo sapiens
ccagggcuccagccagcag

SEQ ID NO: 2605 - RNA, 19 nt, Homo sapiens
ugcuggcuggagcccugga

SEQ ID NO: 2606 - RNA, 19 nt, Homo sapiens
uccagggcuccagccagca

SEQ ID NO: 2607 - RNA, 19 nt, Homo sapiens
gcuggcuggagcccuggag

SEQ ID NO: 2608 - RNA, 19 nt, Homo sapiens
cuccagggcuccagccagc

SEQ ID NO: 2609 - RNA, 19 nt, Homo sapiens
cuggcuggagcccuggagu

SEQ ID NO: 2610 - RNA, 19 nt, Homo sapiens
acuccagggcuccagccag

SEQ ID NO: 2611 - RNA, 19 nt, Homo sapiens
uggcuggagcccuggaguc

SEQ ID NO: 2612 - RNA, 19 nt, Homo sapiens
gacuccagggcuccagcca

SEQ ID NO: 2613 - RNA, 19 nt, Homo sapiens
ggcuggagcccuggagucu

SEQ ID NO: 2614 - RNA, 19 nt, Homo sapiens
agacuccagggcuccagcc

SEQ ID NO: 2615 - RNA, 19 nt, Homo sapiens
gcuggagcccuggagucug

SEQ ID NO: 2616 - RNA, 19 nt, Homo sapiens
cagacuccagggcuccagc

SEQ ID NO: 2617 - RNA, 19 nt, Homo sapiens
cuggagcccuggagucugu

SEQ ID NO: 2618 - RNA, 19 nt, Homo sapiens
acagacuccagggcuccag

SEQ ID NO: 2619 - RNA, 19 nt, Homo sapiens
uggagcccuggagucugug

SEQ ID NO: 2620 - RNA, 19 nt, Homo sapiens
cacagacuccagggcucca

SEQ ID NO: 2621 - RNA, 19 nt, Homo sapiens
ggagcccuggagucugugc

SEQ ID NO: 2622 - RNA, 19 nt, Homo sapiens
gcacagacuccagggcucc

SEQ ID NO: 2623 - RNA, 19 nt, Homo sapiens
gagcccuggagucugugcg

SEQ ID NO: 2624 - RNA, 19 nt, Homo sapiens
cgcacagacuccagggcuc

SEQ ID NO: 2625 - RNA, 19 nt, Homo sapiens
agcccuggagucugugcgg

SEQ ID NO: 2626 - RNA, 19 nt, Homo sapiens
ccgcacagacuccagggcu

SEQ ID NO: 2627 - RNA, 19 nt, Homo sapiens
gcccuggagucugugcgga

SEQ ID NO: 2628 - RNA, 19 nt, Homo sapiens
uccgcacagacuccagggc

SEQ ID NO: 2629 - RNA, 19 nt, Homo sapiens
ccuggagucugugcggauc

SEQ ID NO: 2630 - RNA, 19 nt, Homo sapiens
gauccgcacagacuccagg

SEQ ID NO: 2631 - RNA, 19 nt, Homo sapiens
cuggagucugugcggaucc

SEQ ID NO: 2632 - RNA, 19 nt, Homo sapiens
ggauccgcacagacuccag

SEQ ID NO: 2633 - RNA, 19 nt, Homo sapiens
ggagucugugcggauccug

SEQ ID NO: 2634 - RNA, 19 nt, Homo sapiens
caggauccgcacagacucc

SEQ ID NO: 2635 - RNA, 19 nt, Homo sapiens
gagucugugcggauccuga

SEQ ID NO: 2636 - RNA, 19 nt, Homo sapiens
ucaggauccgcacagacuc

SEQ ID NO: 2637 - RNA, 19 nt, Homo sapiens
agucugugcggauccugaa

SEQ ID NO: 2638 - RNA, 19 nt, Homo sapiens
uucaggauccgcacagacu

SEQ ID NO: 2639 - RNA, 19 nt, Homo sapiens
gucugugcggauccugaag

SEQ ID NO: 2640 - RNA, 19 nt, Homo sapiens
cuucaggauccgcacagac

SEQ ID NO: 2641 - RNA, 19 nt, Homo sapiens
ucugugcggauccugaaga

SEQ ID NO: 2642 - RNA, 19 nt, Homo sapiens
ucuucaggauccgcacaga

SEQ ID NO: 2643 - RNA, 19 nt, Homo sapiens
cugugcggauccugaagag

SEQ ID NO: 2644 - RNA, 19 nt, Homo sapiens
cucuucaggauccgcacag

SEQ ID NO: 2645 - RNA, 19 nt, Homo sapiens
ugugcggauccugaagagc

SEQ ID NO: 2646 - RNA, 19 nt, Homo sapiens
gcucuucaggauccgcaca

SEQ ID NO: 2647 - RNA, 19 nt, Homo sapiens
gugcggauccugaagagcg

SEQ ID NO: 2648 - RNA, 19 nt, Homo sapiens
cgcucuucaggauccgcac

SEQ ID NO: 2649 - RNA, 19 nt, Homo sapiens
ugcggauccugaagagcgc

SEQ ID NO: 2650 - RNA, 19 nt, Homo sapiens
gcgcucuucaggauccgca

SEQ ID NO: 2651 - RNA, 19 nt, Homo sapiens
gcggauccugaagagcgcu

SEQ ID NO: 2652 - RNA, 19 nt, Homo sapiens
agcgcucuucaggauccgc

SEQ ID NO: 2653 - RNA, 19 nt, Homo sapiens
cggauccugaagagcgcug

SEQ ID NO: 2654 - RNA, 19 nt, Homo sapiens
cagcgcucuucaggauccg

SEQ ID NO: 2655 - RNA, 19 nt, Homo sapiens
ggauccugaagagcgcuga

SEQ ID NO: 2656 - RNA, 19 nt, Homo sapiens
ucagcgcucuucaggaucc

SEQ ID NO: 2657 - RNA, 19 nt, Homo sapiens
gauccugaagagcgcugag

SEQ ID NO: 2658 - RNA, 19 nt, Homo sapiens
cucagcgcucuucaggauc

SEQ ID NO: 2659 - RNA, 19 nt, Homo sapiens
auccugaagagcgcugagg

SEQ ID NO: 2660 - RNA, 19 nt, Homo sapiens
ccucagcgcucuucaggau

SEQ ID NO: 2661 - RNA, 19 nt, Homo sapiens
uccugaagagcgcugaggg

SEQ ID NO: 2662 - RNA, 19 nt, Homo sapiens
cccucagcgcucuucagga

SEQ ID NO: 2663 - RNA, 19 nt, Homo sapiens
ccugaagagcgcugaggga

SEQ ID NO: 2664 - RNA, 19 nt, Homo sapiens
ucccucagcgcucuucagg

SEQ ID NO: 2665 - RNA, 19 nt, Homo sapiens
cugaagagcgcugagggac

SEQ ID NO: 2666 - RNA, 19 nt, Homo sapiens
gucccucagcgcucuucag

SEQ ID NO: 2667 - RNA, 19 nt, Homo sapiens
ugaagagcgcugagggacg

SEQ ID NO: 2668 - RNA, 19 nt, Homo sapiens
cgucccucagcgcucuuca

SEQ ID NO: 2669 - RNA, 19 nt, Homo sapiens
gaagagcgcugagggacgg

SEQ ID NO: 2670 - RNA, 19 nt, Homo sapiens
ccgucccucagcgcucuuc

SEQ ID NO: 2671 - RNA, 19 nt, Homo sapiens
aagagcgcugagggacggg

SEQ ID NO: 2672 - RNA, 19 nt, Homo sapiens
cccgucccucagcgcucuu

SEQ ID NO: 2673 - RNA, 19 nt, Homo sapiens
agagcgcugagggacgggu

SEQ ID NO: 2674 - RNA, 19 nt, Homo sapiens
acccgucccucagcgcucu

SEQ ID NO: 2675 - RNA, 19 nt, Homo sapiens
gagcgcugagggacgggug

SEQ ID NO: 2676 - RNA, 19 nt, Homo sapiens
cacccgucccucagcgcuc

SEQ ID NO: 2677 - RNA, 19 nt, Homo sapiens
agcgcugagggacgggugc

SEQ ID NO: 2678 - RNA, 19 nt, Homo sapiens
gcacccgucccucagcgcu

SEQ ID NO: 2679 - RNA, 19 nt, Homo sapiens
gcgcugagggacgggugcu

SEQ ID NO: 2680 - RNA, 19 nt, Homo sapiens
agcacccgucccucagcgc

SEQ ID NO: 2681 - RNA, 19 nt, Homo sapiens
cgcugagggacgggugcuu

SEQ ID NO: 2682 - RNA, 19 nt, Homo sapiens
aagcacccgucccucagcg

SEQ ID NO: 2683 - RNA, 19 nt, Homo sapiens
gcugagggacgggugcuuc

SEQ ID NO: 2684 - RNA, 19 nt, Homo sapiens
gaagcacccgucccucagc

SEQ ID NO: 2685 - RNA, 19 nt, Homo sapiens
cugagggacgggugcuucg

SEQ ID NO: 2686 - RNA, 19 nt, Homo sapiens
cgaagcacccgucccucag

SEQ ID NO: 2687 - RNA, 19 nt, Homo sapiens
ugagggacgggugcuucgc

SEQ ID NO: 2688 - RNA, 19 nt, Homo sapiens
gcgaagcacccgucccuca

SEQ ID NO: 2689 - RNA, 19 nt, Homo sapiens
gagggacgggugcuucgcc

SEQ ID NO: 2690 - RNA, 19 nt, Homo sapiens
ggcgaagcacccgucccuc

SEQ ID NO: 2691 - RNA, 19 nt, Homo sapiens
agggacgggugcuucgccg

SEQ ID NO: 2692 - RNA, 19 nt, Homo sapiens
cggcgaagcacccgucccu

SEQ ID NO: 2693 - RNA, 19 nt, Homo sapiens
gggacgggugcuucgccgc

SEQ ID NO: 2694 - RNA, 19 nt, Homo sapiens
gcggcgaagcacccguccc

SEQ ID NO: 2695 - RNA, 19 nt, Homo sapiens
ggacgggugcuucgccgcc

SEQ ID NO: 2696 - RNA, 19 nt, Homo sapiens
ggcggcgaagcacccgucc

SEQ ID NO: 2697 - RNA, 19 nt, Homo sapiens
gacgggugcuucgccgcca

SEQ ID NO: 2698 - RNA, 19 nt, Homo sapiens
uggcggcgaagcacccguc

SEQ ID NO: 2699 - RNA, 19 nt, Homo sapiens
acgggugcuucgccgccag

SEQ ID NO: 2700 - RNA, 19 nt, Homo sapiens
cuggcggcgaagcacccgu

SEQ ID NO: 2701 - RNA, 19 nt, Homo sapiens
cgggugcuucgccgccagc

SEQ ID NO: 2702 - RNA, 19 nt, Homo sapiens
gcuggcggcgaagcacccg

SEQ ID NO: 2703 - RNA, 19 nt, Homo sapiens
gggugcuucgccgccagca

SEQ ID NO: 2704 - RNA, 19 nt, Homo sapiens
ugcuggcggcgaagcaccc

SEQ ID NO: 2705 - RNA, 19 nt, Homo sapiens
ggugcuucgccgccagcac

SEQ ID NO: 2706 - RNA, 19 nt, Homo sapiens
gugcuggcggcgaagcacc

SEQ ID NO: 2707 - RNA, 19 nt, Homo sapiens
gugcuucgccgccagcacc

SEQ ID NO: 2708 - RNA, 19 nt, Homo sapiens
ggugcuggcggcgaagcac

SEQ ID NO: 2709 - RNA, 19 nt, Homo sapiens
ugcuucgccgccagcacca

SEQ ID NO: 2710 - RNA, 19 nt, Homo sapiens
uggugcuggcggcgaagca

SEQ ID NO: 2711 - RNA, 19 nt, Homo sapiens
gcuucgccgccagcaccag

SEQ ID NO: 2712 - RNA, 19 nt, Homo sapiens
cuggugcuggcggcgaagc

SEQ ID NO: 2713 - RNA, 19 nt, Homo sapiens
cuucgccgccagcaccagc

SEQ ID NO: 2714 - RNA, 19 nt, Homo sapiens
gcuggugcuggcggcgaag

SEQ ID NO: 2715 - RNA, 19 nt, Homo sapiens
uucgccgccagcaccagcg

SEQ ID NO: 2716 - RNA, 19 nt, Homo sapiens
cgcuggugcuggcggcgaa

SEQ ID NO: 2717 - RNA, 19 nt, Homo sapiens
ucgccgccagcaccagcgc

SEQ ID NO: 2718 - RNA, 19 nt, Homo sapiens
gcgcuggugcuggcggcga

SEQ ID NO: 2719 - RNA, 19 nt, Homo sapiens
cgccgccagcaccagcgca

SEQ ID NO: 2720 - RNA, 19 nt, Homo sapiens
ugcgcuggugcuggcggcg

SEQ ID NO: 2721 - RNA, 19 nt, Homo sapiens
gccgccagcaccagcgcaa

SEQ ID NO: 2722 - RNA, 19 nt, Homo sapiens
uugcgcuggugcuggcggc

SEQ ID NO: 2723 - RNA, 19 nt, Homo sapiens
ccgccagcaccagcgcaac

SEQ ID NO: 2724 - RNA, 19 nt, Homo sapiens
guugcgcuggugcuggcgg

SEQ ID NO: 2725 - RNA, 19 nt, Homo sapiens
cgccagcaccagcgcaacg

SEQ ID NO: 2726 - RNA, 19 nt, Homo sapiens
cguugcgcuggugcuggcg

SEQ ID NO: 2727 - RNA, 19 nt, Homo sapiens
gccagcaccagcgcaacgu

SEQ ID NO: 2728 - RNA, 19 nt, Homo sapiens
acguugcgcuggugcuggc

SEQ ID NO: 2729 - RNA, 19 nt, Homo sapiens
cucaugagacagaugcuaa

SEQ ID NO: 2730 - RNA, 19 nt, Homo sapiens
uuagcaucugucucaugag

SEQ ID NO: 2731 - RNA, 19 nt, Homo sapiens
ucaugagacagaugcuaau

SEQ ID NO: 2732 - RNA, 19 nt, Homo sapiens
auuagcaucugucucauga

SEQ ID NO: 2733 - RNA, 19 nt, Homo sapiens
caugagacagaugcuaaug

SEQ ID NO: 2734 - RNA, 19 nt, Homo sapiens
cauuagcaucugucucaug

SEQ ID NO: 2735 - RNA, 19 nt, Homo sapiens
augagacagaugcuaaugg

SEQ ID NO: 2736 - RNA, 19 nt, Homo sapiens
ccauuagcaucugucucau

SEQ ID NO: 2737 - RNA, 19 nt, Homo sapiens
ugagacagaugcuaaugga

SEQ ID NO: 2738 - RNA, 19 nt, Homo sapiens
uccauuagcaucugucuca

SEQ ID NO: 2739 - RNA, 19 nt, Homo sapiens
agacagaugcuaauggaug

SEQ ID NO: 2740 - RNA, 19 nt, Homo sapiens
cauccauuagcaucugucu

SEQ ID NO: 2741 - RNA, 19 nt, Homo sapiens
gacagaugcuaauggaugc

SEQ ID NO: 2742 - RNA, 19 nt, Homo sapiens
gcauccauuagcaucuguc

SEQ ID NO: 2743 - RNA, 19 nt, Homo sapiens
acagaugcuaauggaugcc

SEQ ID NO: 2744 - RNA, 19 nt, Homo sapiens
ggcauccauuagcaucugu

SEQ ID NO: 2745 - RNA, 19 nt, Homo sapiens
cagaugcuaauggaugccg

SEQ ID NO: 2746 - RNA, 19 nt, Homo sapiens
cggcauccauuagcaucug

SEQ ID NO: 2747 - RNA, 19 nt, Homo sapiens
agaugcuaauggaugccgg

SEQ ID NO: 2748 - RNA, 19 nt, Homo sapiens
ccggcauccauuagcaucu

SEQ ID NO: 2749 - RNA, 19 nt, Homo sapiens
gaugcuaauggaugccggc

SEQ ID NO: 2750 - RNA, 19 nt, Homo sapiens
gccggcauccauuagcauc

SEQ ID NO: 2751 - RNA, 19 nt, Homo sapiens
augcuaauggaugccggcc

SEQ ID NO: 2752 - RNA, 19 nt, Homo sapiens
ggccggcauccauuagcau

SEQ ID NO: 2753 - RNA, 19 nt, Homo sapiens
ugcuaauggaugccggccu

SEQ ID NO: 2754 - RNA, 19 nt, Homo sapiens
aggccggcauccauuagca

SEQ ID NO: 2755 - RNA, 19 nt, Homo sapiens
gcuaauggaugccggccuc

SEQ ID NO: 2756 - RNA, 19 nt, Homo sapiens
gaggccggcauccauuagc

SEQ ID NO: 2757 - RNA, 19 nt, Homo sapiens
cuaauggaugccggccucc

SEQ ID NO: 2758 - RNA, 19 nt, Homo sapiens
ggaggccggcauccauuag

SEQ ID NO: 2759 - RNA, 19 nt, Homo sapiens
uaauggaugccggccuccc

SEQ ID NO: 2760 - RNA, 19 nt, Homo sapiens
gggaggccggcauccauua

SEQ ID NO: 2761 - RNA, 19 nt, Homo sapiens
aauggaugccggccucccu

SEQ ID NO: 2762 - RNA, 19 nt, Homo sapiens
agggaggccggcauccauu

SEQ ID NO: 2763 - RNA, 19 nt, Homo sapiens
auggaugccggccucccug

SEQ ID NO: 2764 - RNA, 19 nt, Homo sapiens
cagggaggccggcauccau

SEQ ID NO: 2765 - RNA, 19 nt, Homo sapiens
uggaugccggccucccugu

SEQ ID NO: 2766 - RNA, 19 nt, Homo sapiens
acagggaggccggcaucca

SEQ ID NO: 2767 - RNA, 19 nt, Homo sapiens
ggaugccggccucccuguu

SEQ ID NO: 2768 - RNA, 19 nt, Homo sapiens
aacagggaggccggcaucc

SEQ ID NO: 2769 - RNA, 19 nt, Homo sapiens
gaugccggccucccuguug

SEQ ID NO: 2770 - RNA, 19 nt, Homo sapiens
caacagggaggccggcauc

SEQ ID NO: 2771 - RNA, 19 nt, Homo sapiens
augccggccucccuguugu

SEQ ID NO: 2772 - RNA, 19 nt, Homo sapiens
acaacagggaggccggcau

SEQ ID NO: 2773 - RNA, 19 nt, Homo sapiens
ugccggccucccuguuguc

SEQ ID NO: 2774 - RNA, 19 nt, Homo sapiens
gacaacagggaggccggca

SEQ ID NO: 2775 - RNA, 19 nt, Homo sapiens
gccggccucccuguugucc

SEQ ID NO: 2776 - RNA, 19 nt, Homo sapiens
ggacaacagggaggccggc

SEQ ID NO: 2777 - RNA, 19 nt, Homo sapiens
ccggccucccuguugucca

SEQ ID NO: 2778 - RNA, 19 nt, Homo sapiens
uggacaacagggaggccgg

SEQ ID NO: 2779 - RNA, 19 nt, Homo sapiens
cggccucccuguuguccac

SEQ ID NO: 2780 - RNA, 19 nt, Homo sapiens
guggacaacagggaggccg

SEQ ID NO: 2781 - RNA, 19 nt, Homo sapiens
ggccucccuguuguccacu

SEQ ID NO: 2782 - RNA, 19 nt, Homo sapiens
aguggacaacagggaggcc

SEQ ID NO: 2783 - RNA, 19 nt, Homo sapiens
gccucccuguuguccacug

SEQ ID NO: 2784 - RNA, 19 nt, Homo sapiens
caguggacaacagggaggc

SEQ ID NO: 2785 - RNA, 19 nt, Homo sapiens
ccucccuguuguccacugc

SEQ ID NO: 2786 - RNA, 19 nt, Homo sapiens
gcaguggacaacagggagg

SEQ ID NO: 2787 - RNA, 19 nt, Homo sapiens
cucccuguuguccacugcc

SEQ ID NO: 2788 - RNA, 19 nt, Homo sapiens
ggcaguggacaacagggag

SEQ ID NO: 2789 - RNA, 19 nt, Homo sapiens
ucccuguuguccacugccc

SEQ ID NO: 2790 - RNA, 19 nt, Homo sapiens
gggcaguggacaacaggga

SEQ ID NO: 2791 - RNA, 19 nt, Homo sapiens
cccuguuguccacugcccc

SEQ ID NO: 2792 - RNA, 19 nt, Homo sapiens
ggggcaguggacaacaggg

SEQ ID NO: 2793 - RNA, 19 nt, Homo sapiens
ccuguuguccacugcccca

SEQ ID NO: 2794 - RNA, 19 nt, Homo sapiens
uggggcaguggacaacagg

SEQ ID NO: 2795 - RNA, 19 nt, Homo sapiens
cuguuguccacugccccag

SEQ ID NO: 2796 - RNA, 19 nt, Homo sapiens
cuggggcaguggacaacag

SEQ ID NO: 2797 - RNA, 19 nt, Homo sapiens
uguuguccacugccccagc

SEQ ID NO: 2798 - RNA, 19 nt, Homo sapiens
gcuggggcaguggacaaca

SEQ ID NO: 2799 - RNA, 19 nt, Homo sapiens
guuguccacugccccagcc

SEQ ID NO: 2800 - RNA, 19 nt, Homo sapiens
ggcuggggcaguggacaac

SEQ ID NO: 2801 - RNA, 19 nt, Homo sapiens
uuguccacugccccagcca

SEQ ID NO: 2802 - RNA, 19 nt, Homo sapiens
uggcuggggcaguggacaa

SEQ ID NO: 2803 - RNA, 19 nt, Homo sapiens
uguccacugccccagccac

SEQ ID NO: 2804 - RNA, 19 nt, Homo sapiens
guggcuggggcaguggaca

SEQ ID NO: 2805 - RNA, 19 nt, Homo sapiens
guccacugccccagccaca

SEQ ID NO: 2806 - RNA, 19 nt, Homo sapiens
uguggcuggggcaguggac

SEQ ID NO: 2807 - RNA, 19 nt, Homo sapiens
uccacugccccagccacau

SEQ ID NO: 2808 - RNA, 19 nt, Homo sapiens
auguggcuggggcagugga

SEQ ID NO: 2809 - RNA, 19 nt, Homo sapiens
ccacugccccagccacauc

SEQ ID NO: 2810 - RNA, 19 nt, Homo sapiens
gauguggcuggggcagugg

SEQ ID NO: 2811 - RNA, 19 nt, Homo sapiens
cacugccccagccacauca

SEQ ID NO: 2812 - RNA, 19 nt, Homo sapiens
ugauguggcuggggcagug

SEQ ID NO: 2813 - RNA, 19 nt, Homo sapiens
acugccccagccacaucau

SEQ ID NO: 2814 - RNA, 19 nt, Homo sapiens
augauguggcuggggcagu

SEQ ID NO: 2815 - RNA, 19 nt, Homo sapiens
cugccccagccacaucauc

SEQ ID NO: 2816 - RNA, 19 nt, Homo sapiens
gaugauguggcuggggcag

SEQ ID NO: 2817 - RNA, 19 nt, Homo sapiens
ugccccagccacaucaucc

SEQ ID NO: 2818 - RNA, 19 nt, Homo sapiens
ggaugauguggcuggggca

SEQ ID NO: 2819 - RNA, 19 nt, Homo sapiens
gccccagccacaucauccc

SEQ ID NO: 2820 - RNA, 19 nt, Homo sapiens
gggaugauguggcuggggc

SEQ ID NO: 2821 - RNA, 19 nt, Homo sapiens
ccccagccacaucaucccu

SEQ ID NO: 2822 - RNA, 19 nt, Homo sapiens
agggaugauguggcugggg

SEQ ID NO: 2823 - RNA, 19 nt, Homo sapiens
cccagccacaucaucccug

SEQ ID NO: 2824 - RNA, 19 nt, Homo sapiens
cagggaugauguggcuggg

SEQ ID NO: 2825 - RNA, 19 nt, Homo sapiens
ccagccacaucaucccugu

SEQ ID NO: 2826 - RNA, 19 nt, Homo sapiens
acagggaugauguggcugg

SEQ ID NO: 2827 - RNA, 19 nt, Homo sapiens
cagccacaucaucccugug

SEQ ID NO: 2828 - RNA, 19 nt, Homo sapiens
cacagggaugauguggcug

SEQ ID NO: 2829 - RNA, 19 nt, Homo sapiens
agccacaucaucccugugc

SEQ ID NO: 2830 - RNA, 19 nt, Homo sapiens
gcacagggaugauguggcu

SEQ ID NO: 2831 - RNA, 19 nt, Homo sapiens
gccacaucaucccugugcg

SEQ ID NO: 2832 - RNA, 19 nt, Homo sapiens
cgcacagggaugauguggc

SEQ ID NO: 2833 - RNA, 19 nt, Homo sapiens
ccacaucaucccugugcgg

SEQ ID NO: 2834 - RNA, 19 nt, Homo sapiens
ccgcacagggaugaugugg

SEQ ID NO: 2835 - RNA, 19 nt, Homo sapiens
cacaucaucccugugcggg

SEQ ID NO: 2836 - RNA, 19 nt, Homo sapiens
cccgcacagggaugaugug

SEQ ID NO: 2837 - RNA, 19 nt, Homo sapiens
acaucaucccugugcgggu

SEQ ID NO: 2838 - RNA, 19 nt, Homo sapiens
acccgcacagggaugaugu

SEQ ID NO: 2839 - RNA, 19 nt, Homo sapiens
aucaucccugugcggguug

SEQ ID NO: 2840 - RNA, 19 nt, Homo sapiens
caacccgcacagggaugau

SEQ ID NO: 2841 - RNA, 19 nt, Homo sapiens
ucaucccugugcggguugc

SEQ ID NO: 2842 - RNA, 19 nt, Homo sapiens
gcaacccgcacagggauga

SEQ ID NO: 2843 - RNA, 19 nt, Homo sapiens
caucccugugcggguugca

SEQ ID NO: 2844 - RNA, 19 nt, Homo sapiens
ugcaacccgcacagggaug

SEQ ID NO: 2845 - RNA, 19 nt, Homo sapiens
aucccugugcggguugcag

SEQ ID NO: 2846 - RNA, 19 nt, Homo sapiens
cugcaacccgcacagggau

SEQ ID NO: 2847 - RNA, 19 nt, Homo sapiens
ucccugugcggguugcaga

SEQ ID NO: 2848 - RNA, 19 nt, Homo sapiens
ucugcaacccgcacaggga

SEQ ID NO: 2849 - RNA, 19 nt, Homo sapiens
ccugugcggguugcagaug

SEQ ID NO: 2850 - RNA, 19 nt, Homo sapiens
caucugcaacccgcacagg

SEQ ID NO: 2851 - RNA, 19 nt, Homo sapiens
cugugcggguugcagaugc

SEQ ID NO: 2852 - RNA, 19 nt, Homo sapiens
gcaucugcaacccgcacag

SEQ ID NO: 2853 - RNA, 19 nt, Homo sapiens
ugugcggguugcagaugcu

SEQ ID NO: 2854 - RNA, 19 nt, Homo sapiens
agcaucugcaacccgcaca

SEQ ID NO: 2855 - RNA, 19 nt, Homo sapiens
gugcggguugcagaugcug

SEQ ID NO: 2856 - RNA, 19 nt, Homo sapiens
cagcaucugcaacccgcac

SEQ ID NO: 2857 - RNA, 19 nt, Homo sapiens
ugcggguugcagaugcugc

SEQ ID NO: 2858 - RNA, 19 nt, Homo sapiens
gcagcaucugcaacccgca

SEQ ID NO: 2859 - RNA, 19 nt, Homo sapiens
gcggguugcagaugcugcu

SEQ ID NO: 2860 - RNA, 19 nt, Homo sapiens
agcagcaucugcaacccgc

SEQ ID NO: 2861 - RNA, 19 nt, Homo sapiens
cggguugcagaugcugcua

SEQ ID NO: 2862 - RNA, 19 nt, Homo sapiens
uagcagcaucugcaacccg

SEQ ID NO: 2863 - RNA, 19 nt, Homo sapiens
ggguugcagaugcugcuaa

SEQ ID NO: 2864 - RNA, 19 nt, Homo sapiens
uuagcagcaucugcaaccc

SEQ ID NO: 2865 - RNA, 19 nt, Homo sapiens
gguugcagaugcugcuaaa

SEQ ID NO: 2866 - RNA, 19 nt, Homo sapiens
uuuagcagcaucugcaacc

SEQ ID NO: 2867 - RNA, 19 nt, Homo sapiens
guugcagaugcugcuaaaa

SEQ ID NO: 2868 - RNA, 19 nt, Homo sapiens
uuuuagcagcaucugcaac

SEQ ID NO: 2869 - RNA, 19 nt, Homo sapiens
uugcagaugcugcuaaaaa

SEQ ID NO: 2870 - RNA, 19 nt, Homo sapiens
uuuuuagcagcaucugcaa

SEQ ID NO: 2871 - RNA, 19 nt, Homo sapiens
ugcagaugcugcuaaaaac

SEQ ID NO: 2872 - RNA, 19 nt, Homo sapiens
guuuuuagcagcaucugca

SEQ ID NO: 2873 - RNA, 19 nt, Homo sapiens
gcagaugcugcuaaaaaca

SEQ ID NO: 2874 - RNA, 19 nt, Homo sapiens
uguuuuuagcagcaucugc

SEQ ID NO: 2875 - RNA, 19 nt, Homo sapiens
cagaugcugcuaaaaacac

SEQ ID NO: 2876 - RNA, 19 nt, Homo sapiens
guguuuuuagcagcaucug

SEQ ID NO: 2877 - RNA, 19 nt, Homo sapiens
gaagucugugaugaacuaa

SEQ ID NO: 2878 - RNA, 19 nt, Homo sapiens
uuaguucaucacagacuuc

SEQ ID NO: 2879 - RNA, 19 nt, Homo sapiens
agucugugaugaacuaaug

SEQ ID NO: 2880 - RNA, 19 nt, Homo sapiens
cauuaguucaucacagacu

SEQ ID NO: 2881 - RNA, 19 nt, Homo sapiens
ucugugaugaacuaaugag

SEQ ID NO: 2882 - RNA, 19 nt, Homo sapiens
cucauuaguucaucacaga

SEQ ID NO: 2883 - RNA, 19 nt, Homo sapiens
cugugaugaacuaaugagc

SEQ ID NO: 2884 - RNA, 19 nt, Homo sapiens
gcucauuaguucaucacag

SEQ ID NO: 2885 - RNA, 19 nt, Homo sapiens
gugaugaacuaaugagcag

SEQ ID NO: 2886 - RNA, 19 nt, Homo sapiens
cugcucauuaguucaucac

SEQ ID NO: 2887 - RNA, 19 nt, Homo sapiens
ugaugaacuaaugagcaga

SEQ ID NO: 2888 - RNA, 19 nt, Homo sapiens
ucugcucauuaguucauca

SEQ ID NO: 2889 - RNA, 19 nt, Homo sapiens
gaugaacuaaugagcagac

SEQ ID NO: 2890 - RNA, 19 nt, Homo sapiens
gucugcucauuaguucauc

SEQ ID NO: 2891 - RNA, 19 nt, Homo sapiens
augaacuaaugagcagaca

SEQ ID NO: 2892 - RNA, 19 nt, Homo sapiens
ugucugcucauuaguucau

SEQ ID NO: 2893 - RNA, 19 nt, Homo sapiens
ugaacuaaugagcagacau

SEQ ID NO: 2894 - RNA, 19 nt, Homo sapiens
augucugcucauuaguuca

SEQ ID NO: 2895 - RNA, 19 nt, Homo sapiens
gaacuaaugagcagacaua

SEQ ID NO: 2896 - RNA, 19 nt, Homo sapiens
uaugucugcucauuaguuc

SEQ ID NO: 2897 - RNA, 19 nt, Homo sapiens
aacuaaugagcagacauaa

SEQ ID NO: 2898 - RNA, 19 nt, Homo sapiens
uuaugucugcucauuaguu

SEQ ID NO: 2899 - RNA, 19 nt, Homo sapiens
acuaaugagcagacauaac

SEQ ID NO: 2900 - RNA, 19 nt, Homo sapiens
guuaugucugcucauuagu

SEQ ID NO: 2901 - RNA, 19 nt, Homo sapiens
aaugagcagacauaacauc

SEQ ID NO: 2902 - RNA, 19 nt, Homo sapiens
gauguuaugucugcucauu

SEQ ID NO: 2903 - RNA, 19 nt, Homo sapiens
augagcagacauaacaucu

SEQ ID NO: 2904 - RNA, 19 nt, Homo sapiens
agauguuaugucugcucau

SEQ ID NO: 2905 - RNA, 19 nt, Homo sapiens
ugagcagacauaacaucua

SEQ ID NO: 2906 - RNA, 19 nt, Homo sapiens
uagauguuaugucugcuca

SEQ ID NO: 2907 - RNA, 19 nt, Homo sapiens
gugcaagcaaucaauuacc

SEQ ID NO: 2908 - RNA, 19 nt, Homo sapiens
gguaauugauugcuugcac

SEQ ID NO: 2909 - RNA, 19 nt, Homo sapiens
ugcaagcaaucaauuaccc

SEQ ID NO: 2910 - RNA, 19 nt, Homo sapiens
ggguaauugauugcuugca

SEQ ID NO: 2911 - RNA, 19 nt, Homo sapiens
gcaagcaaucaauuacccu

SEQ ID NO: 2912 - RNA, 19 nt, Homo sapiens
aggguaauugauugcuugc

SEQ ID NO: 2913 - RNA, 19 nt, Homo sapiens
aagcaaucaauuacccuac

SEQ ID NO: 2914 - RNA, 19 nt, Homo sapiens
guaggguaauugauugcuu

SEQ ID NO: 2915 - RNA, 19 nt, Homo sapiens
gugccccggggagaagagc

SEQ ID NO: 2916 - RNA, 19 nt, Homo sapiens
gcucuucuccccggggcac

SEQ ID NO: 2917 - RNA, 19 nt, Homo sapiens
ugccccggggagaagagcu

SEQ ID NO: 2918 - RNA, 19 nt, Homo sapiens
agcucuucuccccggggca

SEQ ID NO: 2919 - RNA, 19 nt, Homo sapiens
gccccggggagaagagcuc

SEQ ID NO: 2920 - RNA, 19 nt, Homo sapiens
gagcucuucuccccggggc

SEQ ID NO: 2921 - RNA, 19 nt, Homo sapiens
ccccggggagaagagcucc

SEQ ID NO: 2922 - RNA, 19 nt, Homo sapiens
ggagcucuucuccccgggg

SEQ ID NO: 2923 - RNA, 19 nt, Homo sapiens
cccggggagaagagcuccu

SEQ ID NO: 2924 - RNA, 19 nt, Homo sapiens
aggagcucuucuccccggg

SEQ ID NO: 2925 - RNA, 19 nt, Homo sapiens
ccggggagaagagcuccua

SEQ ID NO: 2926 - RNA, 19 nt, Homo sapiens
uaggagcucuucuccccgg

SEQ ID NO: 2927 - RNA, 19 nt, Homo sapiens
cggggagaagagcuccuac

SEQ ID NO: 2928 - RNA, 19 nt, Homo sapiens
guaggagcucuucuccccg

SEQ ID NO: 2929 - RNA, 19 nt, Homo sapiens
ggggagaagagcuccuacg

SEQ ID NO: 2930 - RNA, 19 nt, Homo sapiens
cguaggagcucuucucccc

SEQ ID NO: 2931 - RNA, 19 nt, Homo sapiens
gggagaagagcuccuacgg

SEQ ID NO: 2932 - RNA, 19 nt, Homo sapiens
ccguaggagcucuucuccc

SEQ ID NO: 2933 - RNA, 19 nt, Homo sapiens
ggagaagagcuccuacgga

SEQ ID NO: 2934 - RNA, 19 nt, Homo sapiens
uccguaggagcucuucucc

SEQ ID NO: 2935 - RNA, 19 nt, Homo sapiens
gagaagagcuccuacggau

SEQ ID NO: 2936 - RNA, 19 nt, Homo sapiens
auccguaggagcucuucuc

SEQ ID NO: 2937 - RNA, 19 nt, Homo sapiens
accccucaccacacacccc

SEQ ID NO: 2938 - RNA, 19 nt, Homo sapiens
gggguguguggugaggggu

SEQ ID NO: 2939 - RNA, 19 nt, Homo sapiens
ccccucaccacacacccca

SEQ ID NO: 2940 - RNA, 19 nt, Homo sapiens
ugggguguguggugagggg

SEQ ID NO: 2941 - RNA, 19 nt, Homo sapiens
cccucaccacacaccccag

SEQ ID NO: 2942 - RNA, 19 nt, Homo sapiens
cugggguguguggugaggg

SEQ ID NO: 2943 - RNA, 19 nt, Homo sapiens
ccucaccacacaccccaga

SEQ ID NO: 2944 - RNA, 19 nt, Homo sapiens
ucugggguguguggugagg

SEQ ID NO: 2945 - RNA, 19 nt, Homo sapiens
cucaccacacaccccagau

SEQ ID NO: 2946 - RNA, 19 nt, Homo sapiens
aucugggguguguggugag

SEQ ID NO: 2947 - RNA, 19 nt, Homo sapiens
ucaccacacaccccagaug

SEQ ID NO: 2948 - RNA, 19 nt, Homo sapiens
caucuggggugugugguga

SEQ ID NO: 2949 - RNA, 19 nt, Homo sapiens
caccacacaccccagauga

SEQ ID NO: 2950 - RNA, 19 nt, Homo sapiens
ucaucugggguguguggug

SEQ ID NO: 2951 - RNA, 19 nt, Homo sapiens
accacacaccccagaugau

SEQ ID NO: 2952 - RNA, 19 nt, Homo sapiens
aucaucugggguguguggu

SEQ ID NO: 2953 - RNA, 19 nt, Homo sapiens
ccacacaccccagaugaug

SEQ ID NO: 2954 - RNA, 19 nt, Homo sapiens
caucaucuggggugugugg

SEQ ID NO: 2955 - RNA, 19 nt, Homo sapiens
cacacaccccagaugauga

SEQ ID NO: 2956 - RNA, 19 nt, Homo sapiens
ucaucaucuggggugugug

SEQ ID NO: 2957 - RNA, 19 nt, Homo sapiens
acacaccccagaugaugaa

SEQ ID NO: 2958 - RNA, 19 nt, Homo sapiens
uucaucaucuggggugugu

SEQ ID NO: 2959 - RNA, 19 nt, Homo sapiens
cacaccccagaugaugaac

SEQ ID NO: 2960 - RNA, 19 nt, Homo sapiens
guucaucaucuggggugug

SEQ ID NO: 2961 - RNA, 19 nt, Homo sapiens
acaccccagaugaugaacu

SEQ ID NO: 2962 - RNA, 19 nt, Homo sapiens
aguucaucaucuggggugu

SEQ ID NO: 2963 - RNA, 19 nt, Homo sapiens
caccccagaugaugaacua

SEQ ID NO: 2964 - RNA, 19 nt, Homo sapiens
uaguucaucaucuggggug

SEQ ID NO: 2965 - RNA, 19 nt, Homo sapiens
accccagaugaugaacuac

SEQ ID NO: 2966 - RNA, 19 nt, Homo sapiens
guaguucaucaucuggggu

SEQ ID NO: 2967 - RNA, 19 nt, Homo sapiens
cccagaugaugaacuacuu

SEQ ID NO: 2968 - RNA, 19 nt, Homo sapiens
aaguaguucaucaucuggg

SEQ ID NO: 2969 - RNA, 19 nt, Homo sapiens
ccagaugaugaacuacuuc

SEQ ID NO: 2970 - RNA, 19 nt, Homo sapiens
gaaguaguucaucaucugg

SEQ ID NO: 2971 - RNA, 19 nt, Homo sapiens
cagaugaugaacuacuucc

SEQ ID NO: 2972 - RNA, 19 nt, Homo sapiens
ggaaguaguucaucaucug

SEQ ID NO: 2973 - RNA, 19 nt, Homo sapiens
agaugaugaacuacuuccu

SEQ ID NO: 2974 - RNA, 19 nt, Homo sapiens
aggaaguaguucaucaucu

SEQ ID NO: 2975 - RNA, 19 nt, Homo sapiens
gaugaugaacuacuuccuu

SEQ ID NO: 2976 - RNA, 19 nt, Homo sapiens
aaggaaguaguucaucauc

SEQ ID NO: 2977 - RNA, 19 nt, Homo sapiens
augaugaacuacuuccuug

SEQ ID NO: 2978 - RNA, 19 nt, Homo sapiens
caaggaaguaguucaucau

SEQ ID NO: 2979 - RNA, 19 nt, Homo sapiens
ugaugaacuacuuccuuga

SEQ ID NO: 2980 - RNA, 19 nt, Homo sapiens
ucaaggaaguaguucauca

SEQ ID NO: 2981 - RNA, 19 nt, Homo sapiens
gaugaacuacuuccuugag

SEQ ID NO: 2982 - RNA, 19 nt, Homo sapiens
cucaaggaaguaguucauc

SEQ ID NO: 2983 - RNA, 19 nt, Homo sapiens
augaacuacuuccuugaga

SEQ ID NO: 2984 - RNA, 19 nt, Homo sapiens
ucucaaggaaguaguucau

SEQ ID NO: 2985 - RNA, 19 nt, Homo sapiens
ugaacuacuuccuugagaa

SEQ ID NO: 2986 - RNA, 19 nt, Homo sapiens
uucucaaggaaguaguuca

SEQ ID NO: 2987 - RNA, 19 nt, Homo sapiens
gaacuacuuccuugagaau

SEQ ID NO: 2988 - RNA, 19 nt, Homo sapiens
auucucaaggaaguaguuc

SEQ ID NO: 2989 - RNA, 19 nt, Homo sapiens
aacuacuuccuugagaauc

SEQ ID NO: 2990 - RNA, 19 nt, Homo sapiens
gauucucaaggaaguaguu

SEQ ID NO: 2991 - RNA, 19 nt, Homo sapiens
acuacuuccuugagaaucu

SEQ ID NO: 2992 - RNA, 19 nt, Homo sapiens
agauucucaaggaaguagu

SEQ ID NO: 2993 - RNA, 19 nt, Homo sapiens
cuacuuccuugagaaucug

SEQ ID NO: 2994 - RNA, 19 nt, Homo sapiens
cagauucucaaggaaguag

SEQ ID NO: 2995 - RNA, 19 nt, Homo sapiens
uacuuccuugagaaucugc

SEQ ID NO: 2996 - RNA, 19 nt, Homo sapiens
gcagauucucaaggaagua

SEQ ID NO: 2997 - RNA, 19 nt, Homo sapiens
acuuccuugagaaucugcu

SEQ ID NO: 2998 - RNA, 19 nt, Homo sapiens
agcagauucucaaggaagu

SEQ ID NO: 2999 - RNA, 19 nt, Homo sapiens
uggaagcaaguggggcugg

SEQ ID NO: 3000 - RNA, 19 nt, Homo sapiens
ccagccccacuugcuucca

SEQ ID NO: 3001 - RNA, 19 nt, Homo sapiens
ggaagcaaguggggcugga

SEQ ID NO: 3002 - RNA, 19 nt, Homo sapiens
uccagccccacuugcuucc

SEQ ID NO: 3003 - RNA, 19 nt, Homo sapiens
gaagcaaguggggcuggaa

SEQ ID NO: 3004 - RNA, 19 nt, Homo sapiens
uuccagccccacuugcuuc

SEQ ID NO: 3005 - RNA, 19 nt, Homo sapiens
aagcaaguggggcuggaac

SEQ ID NO: 3006 - RNA, 19 nt, Homo sapiens
guuccagccccacuugcuu

SEQ ID NO: 3007 - RNA, 19 nt, Homo sapiens
agcaaguggggcuggaacu

SEQ ID NO: 3008 - RNA, 19 nt, Homo sapiens
aguuccagccccacuugcu

SEQ ID NO: 3009 - RNA, 19 nt, Homo sapiens
gcaaguggggcuggaacug

SEQ ID NO: 3010 - RNA, 19 nt, Homo sapiens
caguuccagccccacuugc

SEQ ID NO: 3011 - RNA, 19 nt, Homo sapiens
caaguggggcuggaacuga

SEQ ID NO: 3012 - RNA, 19 nt, Homo sapiens
ucaguuccagccccacuug

SEQ ID NO: 3013 - RNA, 19 nt, Homo sapiens
aaguggggcuggaacugaa

SEQ ID NO: 3014 - RNA, 19 nt, Homo sapiens
uucaguuccagccccacuu

SEQ ID NO: 3015 - RNA, 19 nt, Homo sapiens
aguggggcuggaacugaag

SEQ ID NO: 3016 - RNA, 19 nt, Homo sapiens
cuucaguuccagccccacu

SEQ ID NO: 3017 - RNA, 19 nt, Homo sapiens
guggggcuggaacugaagc

SEQ ID NO: 3018 - RNA, 19 nt, Homo sapiens
gcuucaguuccagccccac

SEQ ID NO: 3019 - RNA, 19 nt, Homo sapiens
uggggcuggaacugaagcc

SEQ ID NO: 3020 - RNA, 19 nt, Homo sapiens
ggcuucaguuccagcccca

SEQ ID NO: 3021 - RNA, 19 nt, Homo sapiens
cauuccucagcugagugca

SEQ ID NO: 3022 - RNA, 19 nt, Homo sapiens
ugcacucagcugaggaaug

SEQ ID NO: 3023 - RNA, 19 nt, Homo sapiens
auuccucagcugagugcaa

SEQ ID NO: 3024 - RNA, 19 nt, Homo sapiens
uugcacucagcugaggaau

SEQ ID NO: 3025 - RNA, 19 nt, Homo sapiens
uuccucagcugagugcaac

SEQ ID NO: 3026 - RNA, 19 nt, Homo sapiens
guugcacucagcugaggaa

SEQ ID NO: 3027 - RNA, 19 nt, Homo sapiens
uccucagcugagugcaacu

SEQ ID NO: 3028 - RNA, 19 nt, Homo sapiens
aguugcacucagcugagga

SEQ ID NO: 3029 - RNA, 19 nt, Homo sapiens
ccucagcugagugcaacuu

SEQ ID NO: 3030 - RNA, 19 nt, Homo sapiens
aaguugcacucagcugagg

SEQ ID NO: 3031 - RNA, 19 nt, Homo sapiens
cucagcugagugcaacuuc

SEQ ID NO: 3032 - RNA, 19 nt, Homo sapiens
gaaguugcacucagcugag

SEQ ID NO: 3033 - RNA, 19 nt, Homo sapiens
ucagcugagugcaacuucu

SEQ ID NO: 3034 - RNA, 19 nt, Homo sapiens
agaaguugcacucagcuga

SEQ ID NO: 3035 - RNA, 19 nt, Homo sapiens
cagcugagugcaacuucug

SEQ ID NO: 3036 - RNA, 19 nt, Homo sapiens
cagaaguugcacucagcug

SEQ ID NO: 3037 - RNA, 19 nt, Homo sapiens
agcugagugcaacuucugc

SEQ ID NO: 3038 - RNA, 19 nt, Homo sapiens
gcagaaguugcacucagcu

SEQ ID NO: 3039 - RNA, 19 nt, Homo sapiens
gcugagugcaacuucugca

SEQ ID NO: 3040 - RNA, 19 nt, Homo sapiens
ugcagaaguugcacucagc

SEQ ID NO: 3041 - RNA, 19 nt, Homo sapiens
cugagugcaacuucugcag

SEQ ID NO: 3042 - RNA, 19 nt, Homo sapiens
cugcagaaguugcacucag

SEQ ID NO: 3043 - RNA, 19 nt, Homo sapiens
ugagugcaacuucugcagg

SEQ ID NO: 3044 - RNA, 19 nt, Homo sapiens
ccugcagaaguugcacuca

SEQ ID NO: 3045 - RNA, 19 nt, Homo sapiens
gagugcaacuucugcagga

SEQ ID NO: 3046 - RNA, 19 nt, Homo sapiens
uccugcagaaguugcacuc

SEQ ID NO: 3047 - RNA, 19 nt, Homo sapiens
agugcaacuucugcaggag

SEQ ID NO: 3048 - RNA, 19 nt, Homo sapiens
cuccugcagaaguugcacu

SEQ ID NO: 3049 - RNA, 19 nt, Homo sapiens
gugcaacuucugcaggagg

SEQ ID NO: 3050 - RNA, 19 nt, Homo sapiens
ccuccugcagaaguugcac

SEQ ID NO: 3051 - RNA, 19 nt, Homo sapiens
ugcaacuucugcaggaggc

SEQ ID NO: 3052 - RNA, 19 nt, Homo sapiens
gccuccugcagaaguugca

SEQ ID NO: 3053 - RNA, 19 nt, Homo sapiens
gcaacuucugcaggaggcc

SEQ ID NO: 3054 - RNA, 19 nt, Homo sapiens
ggccuccugcagaaguugc

SEQ ID NO: 3055 - RNA, 19 nt, Homo sapiens
caacuucugcaggaggcca

SEQ ID NO: 3056 - RNA, 19 nt, Homo sapiens
uggccuccugcagaaguug

SEQ ID NO: 3057 - RNA, 19 nt, Homo sapiens
aacuucugcaggaggccac

SEQ ID NO: 3058 - RNA, 19 nt, Homo sapiens
guggccuccugcagaaguu

SEQ ID NO: 3059 - RNA, 19 nt, Homo sapiens
acuucugcaggaggccacu

SEQ ID NO: 3060 - RNA, 19 nt, Homo sapiens
aguggccuccugcagaagu

SEQ ID NO: 3061 - RNA, 19 nt, Homo sapiens
cuucugcaggaggccacug

SEQ ID NO: 3062 - RNA, 19 nt, Homo sapiens
caguggccuccugcagaag

SEQ ID NO: 3063 - RNA, 19 nt, Homo sapiens
uucugcaggaggccacugc

SEQ ID NO: 3064 - RNA, 19 nt, Homo sapiens
gcaguggccuccugcagaa

SEQ ID NO: 3065 - RNA, 19 nt, Homo sapiens
ucugcaggaggccacugca

SEQ ID NO: 3066 - RNA, 19 nt, Homo sapiens
ugcaguggccuccugcaga

SEQ ID NO: 3067 - RNA, 19 nt, Homo sapiens
cugcaggaggccacugcau

SEQ ID NO: 3068 - RNA, 19 nt, Homo sapiens
augcaguggccuccugcag

SEQ ID NO: 3069 - RNA, 19 nt, Homo sapiens
ugcaggaggccacugcauu

SEQ ID NO: 3070 - RNA, 19 nt, Homo sapiens
aaugcaguggccuccugca

SEQ ID NO: 3071 - RNA, 19 nt, Homo sapiens
gcaggaggccacugcauuu

SEQ ID NO: 3072 - RNA, 19 nt, Homo sapiens
aaaugcaguggccuccugc

SEQ ID NO: 3073 - RNA, 19 nt, Homo sapiens
caggaggccacugcauuuu

SEQ ID NO: 3074 - RNA, 19 nt, Homo sapiens
aaaaugcaguggccuccug

SEQ ID NO: 3075 - RNA, 19 nt, Homo sapiens
aggaggccacugcauuuug

SEQ ID NO: 3076 - RNA, 19 nt, Homo sapiens
caaaaugcaguggccuccu

SEQ ID NO: 3077 - RNA, 19 nt, Homo sapiens
ggaggccacugcauuuuga

SEQ ID NO: 3078 - RNA, 19 nt, Homo sapiens
ucaaaaugcaguggccucc

SEQ ID NO: 3079 - RNA, 19 nt, Homo sapiens
gaggccacugcauuuugaa

SEQ ID NO: 3080 - RNA, 19 nt, Homo sapiens
uucaaaaugcaguggccuc

SEQ ID NO: 3081 - RNA, 19 nt, Homo sapiens
aggccacugcauuuugaag

SEQ ID NO: 3082 - RNA, 19 nt, Homo sapiens
cuucaaaaugcaguggccu

SEQ ID NO: 3083 - RNA, 19 nt, Homo sapiens
ggccacugcauuuugaagu

SEQ ID NO: 3084 - RNA, 19 nt, Homo sapiens
acuucaaaaugcaguggcc

SEQ ID NO: 3085 - RNA, 19 nt, Homo sapiens
gccacugcauuuugaagug

SEQ ID NO: 3086 - RNA, 19 nt, Homo sapiens
cacuucaaaaugcaguggc

SEQ ID NO: 3087 - RNA, 19 nt, Homo sapiens
ccacugcauuuugaaguga

SEQ ID NO: 3088 - RNA, 19 nt, Homo sapiens
ucacuucaaaaugcagugg

SEQ ID NO: 3089 - RNA, 19 nt, Homo sapiens
cacugcauuuugaagugau

SEQ ID NO: 3090 - RNA, 19 nt, Homo sapiens
aucacuucaaaaugcagug

SEQ ID NO: 3091 - RNA, 19 nt, Homo sapiens
acugcauuuugaagugaug

SEQ ID NO: 3092 - RNA, 19 nt, Homo sapiens
caucacuucaaaaugcagu

SEQ ID NO: 3093 - RNA, 19 nt, Homo sapiens
cugcauuuugaagugauga

SEQ ID NO: 3094 - RNA, 19 nt, Homo sapiens
ucaucacuucaaaaugcag

SEQ ID NO: 3095 - RNA, 19 nt, Homo sapiens
ugcauuuugaagugaugag

SEQ ID NO: 3096 - RNA, 19 nt, Homo sapiens
cucaucacuucaaaaugca

SEQ ID NO: 3097 - RNA, 19 nt, Homo sapiens
gcauuuugaagugaugagu

SEQ ID NO: 3098 - RNA, 19 nt, Homo sapiens
acucaucacuucaaaaugc

SEQ ID NO: 3099 - RNA, 19 nt, Homo sapiens
cauuuugaagugaugagug

SEQ ID NO: 3100 - RNA, 19 nt, Homo sapiens
cacucaucacuucaaaaug

SEQ ID NO: 3101 - RNA, 19 nt, Homo sapiens
auuuugaagugaugaguga

SEQ ID NO: 3102 - RNA, 19 nt, Homo sapiens
ucacucaucacuucaaaau

SEQ ID NO: 3103 - RNA, 19 nt, Homo sapiens
uuuugaagugaugagugaa

SEQ ID NO: 3104 - RNA, 19 nt, Homo sapiens
uucacucaucacuucaaaa

SEQ ID NO: 3105 - RNA, 19 nt, Homo sapiens
uugaagugaugagugaaag

SEQ ID NO: 3106 - RNA, 19 nt, Homo sapiens
cuuucacucaucacuucaa

SEQ ID NO: 3107 - RNA, 19 nt, Homo sapiens
ugaagugaugagugaaaga

SEQ ID NO: 3108 - RNA, 19 nt, Homo sapiens
ucuuucacucaucacuuca

SEQ ID NO: 3109 - RNA, 19 nt, Homo sapiens
gaagugaugagugaaagag

SEQ ID NO: 3110 - RNA, 19 nt, Homo sapiens
cucuuucacucaucacuuc

SEQ ID NO: 3111 - RNA, 19 nt, Homo sapiens
aagugaugagugaaagaga

SEQ ID NO: 3112 - RNA, 19 nt, Homo sapiens
ucucuuucacucaucacuu

SEQ ID NO: 3113 - RNA, 19 nt, Homo sapiens
agugaugagugaaagagag

SEQ ID NO: 3114 - RNA, 19 nt, Homo sapiens
cucucuuucacucaucacu

SEQ ID NO: 3115 - RNA, 19 nt, Homo sapiens
gugaugagugaaagagaga

SEQ ID NO: 3116 - RNA, 19 nt, Homo sapiens
ucucucuuucacucaucac

SEQ ID NO: 3117 - RNA, 19 nt, Homo sapiens
ugaugagugaaagagagaa

SEQ ID NO: 3118 - RNA, 19 nt, Homo sapiens
uucucucuuucacucauca

SEQ ID NO: 3119 - RNA, 19 nt, Homo sapiens
gaugagugaaagagagaag

SEQ ID NO: 3120 - RNA, 19 nt, Homo sapiens
cuucucucuuucacucauc

SEQ ID NO: 3121 - RNA, 19 nt, Homo sapiens
augagugaaagagagaagu

SEQ ID NO: 3122 - RNA, 19 nt, Homo sapiens
acuucucucuuucacucau

SEQ ID NO: 3123 - RNA, 19 nt, Homo sapiens
ugagugaaagagagaaguc

SEQ ID NO: 3124 - RNA, 19 nt, Homo sapiens
gacuucucucuuucacuca

SEQ ID NO: 3125 - RNA, 19 nt, Homo sapiens
gagugaaagagagaagucc

SEQ ID NO: 3126 - RNA, 19 nt, Homo sapiens
ggacuucucucuuucacuc

SEQ ID NO: 3127 - RNA, 19 nt, Homo sapiens
agugaaagagagaaguccu

SEQ ID NO: 3128 - RNA, 19 nt, Homo sapiens
aggacuucucucuuucacu

SEQ ID NO: 3129 - RNA, 19 nt, Homo sapiens
gugaaagagagaaguccua

SEQ ID NO: 3130 - RNA, 19 nt, Homo sapiens
uaggacuucucucuuucac

SEQ ID NO: 3131 - RNA, 19 nt, Homo sapiens
ugaaagagagaaguccuau

SEQ ID NO: 3132 - RNA, 19 nt, Homo sapiens
auaggacuucucucuuuca

SEQ ID NO: 3133 - RNA, 19 nt, Homo sapiens
gaaagagagaaguccuauu

SEQ ID NO: 3134 - RNA, 19 nt, Homo sapiens
aauaggacuucucucuuuc

SEQ ID NO: 3135 - RNA, 19 nt, Homo sapiens
aaagagagaaguccuauuu

SEQ ID NO: 3136 - RNA, 19 nt, Homo sapiens
aaauaggacuucucucuuu

SEQ ID NO: 3137 - RNA, 19 nt, Homo sapiens
aagagagaaguccuauuuc

SEQ ID NO: 3138 - RNA, 19 nt, Homo sapiens
gaaauaggacuucucucuu

SEQ ID NO: 3139 - RNA, 19 nt, Homo sapiens
agagagaaguccuauuucu

SEQ ID NO: 3140 - RNA, 19 nt, Homo sapiens
agaaauaggacuucucucu

SEQ ID NO: 3141 - RNA, 19 nt, Homo sapiens
gagagaaguccuauuucuc

SEQ ID NO: 3142 - RNA, 19 nt, Homo sapiens
gagaaauaggacuucucuc

SEQ ID NO: 3143 - RNA, 19 nt, Homo sapiens
agagaaguccuauuucuca

SEQ ID NO: 3144 - RNA, 19 nt, Homo sapiens
ugagaaauaggacuucucu

SEQ ID NO: 3145 - RNA, 19 nt, Homo sapiens
gagaaguccuauuucucag

SEQ ID NO: 3146 - RNA, 19 nt, Homo sapiens
cugagaaauaggacuucuc

SEQ ID NO: 3147 - RNA, 19 nt, Homo sapiens
agaaguccuauuucucagg

SEQ ID NO: 3148 - RNA, 19 nt, Homo sapiens
ccugagaaauaggacuucu

SEQ ID NO: 3149 - RNA, 19 nt, Homo sapiens
gaaguccuauuucucaggc

SEQ ID NO: 3150 - RNA, 19 nt, Homo sapiens
gccugagaaauaggacuuc

SEQ ID NO: 3151 - RNA, 19 nt, Homo sapiens
aaguccuauuucucaggcu

SEQ ID NO: 3152 - RNA, 19 nt, Homo sapiens
agccugagaaauaggacuu

SEQ ID NO: 3153 - RNA, 19 nt, Homo sapiens
aguccuauuucucaggcuu

SEQ ID NO: 3154 - RNA, 19 nt, Homo sapiens
aagccugagaaauaggacu

SEQ ID NO: 3155 - RNA, 19 nt, Homo sapiens
guccuauuucucaggcuug

SEQ ID NO: 3156 - RNA, 19 nt, Homo sapiens
caagccugagaaauaggac

SEQ ID NO: 3157 - RNA, 19 nt, Homo sapiens
uccuauuucucaggcuuga

SEQ ID NO: 3158 - RNA, 19 nt, Homo sapiens
ucaagccugagaaauagga

SEQ ID NO: 3159 - RNA, 19 nt, Homo sapiens
ccuauuucucaggcuugag

SEQ ID NO: 3160 - RNA, 19 nt, Homo sapiens
cucaagccugagaaauagg

SEQ ID NO: 3161 - RNA, 19 nt, Homo sapiens
cuauuucucaggcuugagc

SEQ ID NO: 3162 - RNA, 19 nt, Homo sapiens
gcucaagccugagaaauag

SEQ ID NO: 3163 - RNA, 19 nt, Homo sapiens
uauuucucaggcuugagca

SEQ ID NO: 3164 - RNA, 19 nt, Homo sapiens
ugcucaagccugagaaaua

SEQ ID NO: 3165 - RNA, 19 nt, Homo sapiens
auuucucaggcuugagcaa

SEQ ID NO: 3166 - RNA, 19 nt, Homo sapiens
uugcucaagccugagaaau

SEQ ID NO: 3167 - RNA, 19 nt, Homo sapiens
uuucucaggcuugagcaag

SEQ ID NO: 3168 - RNA, 19 nt, Homo sapiens
cuugcucaagccugagaaa

SEQ ID NO: 3169 - RNA, 19 nt, Homo sapiens
uucucaggcuugagcaagu

SEQ ID NO: 3170 - RNA, 19 nt, Homo sapiens
acuugcucaagccugagaa

SEQ ID NO: 3171 - RNA, 19 nt, Homo sapiens
ucucaggcuugagcaaguu

SEQ ID NO: 3172 - RNA, 19 nt, Homo sapiens
aacuugcucaagccugaga

SEQ ID NO: 3173 - RNA, 19 nt, Homo sapiens
cucaggcuugagcaaguug

SEQ ID NO: 3174 - RNA, 19 nt, Homo sapiens
caacuugcucaagccugag

SEQ ID NO: 3175 - RNA, 19 nt, Homo sapiens
ucaggcuugagcaaguugg

SEQ ID NO: 3176 - RNA, 19 nt, Homo sapiens
ccaacuugcucaagccuga

SEQ ID NO: 3177 - RNA, 19 nt, Homo sapiens
caggcuugagcaaguuggu

SEQ ID NO: 3178 - RNA, 19 nt, Homo sapiens
accaacuugcucaagccug

SEQ ID NO: 3179 - RNA, 19 nt, Homo sapiens
gcuugagcaaguugguauc

SEQ ID NO: 3180 - RNA, 19 nt, Homo sapiens
gauaccaacuugcucaagc

SEQ ID NO: 3181 - RNA, 19 nt, Homo sapiens
uugagcaaguugguaucug

SEQ ID NO: 3182 - RNA, 19 nt, Homo sapiens
cagauaccaacuugcucaa

SEQ ID NO: 3183 - RNA, 19 nt, Homo sapiens
ugagcaaguugguaucugc

SEQ ID NO: 3184 - RNA, 19 nt, Homo sapiens
gcagauaccaacuugcuca

SEQ ID NO: 3185 - RNA, 19 nt, Homo sapiens
gagcaaguugguaucugcu

SEQ ID NO: 3186 - RNA, 19 nt, Homo sapiens
agcagauaccaacuugcuc

SEQ ID NO: 3187 - RNA, 19 nt, Homo sapiens
agcaaguugguaucugcuc

SEQ ID NO: 3188 - RNA, 19 nt, Homo sapiens
gagcagauaccaacuugcu

SEQ ID NO: 3189 - RNA, 19 nt, Homo sapiens
gcaaguugguaucugcuca

SEQ ID NO: 3190 - RNA, 19 nt, Homo sapiens
ugagcagauaccaacuugc

SEQ ID NO: 3191 - RNA, 19 nt, Homo sapiens
caaguugguaucugcucag

SEQ ID NO: 3192 - RNA, 19 nt, Homo sapiens
cugagcagauaccaacuug

SEQ ID NO: 3193 - RNA, 19 nt, Homo sapiens
aaguugguaucugcucagg

SEQ ID NO: 3194 - RNA, 19 nt, Homo sapiens
ccugagcagauaccaacuu

SEQ ID NO: 3195 - RNA, 19 nt, Homo sapiens
aguugguaucugcucaggc

SEQ ID NO: 3196 - RNA, 19 nt, Homo sapiens
gccugagcagauaccaacu

SEQ ID NO: 3197 - RNA, 19 nt, Homo sapiens
guugguaucugcucaggcc

SEQ ID NO: 3198 - RNA, 19 nt, Homo sapiens
ggccugagcagauaccaac

SEQ ID NO: 3199 - RNA, 19 nt, Homo sapiens
uugguaucugcucaggccu

SEQ ID NO: 3200 - RNA, 19 nt, Homo sapiens
aggccugagcagauaccaa

SEQ ID NO: 3201 - RNA, 19 nt, Homo sapiens
ugguaucugcucaggccug

SEQ ID NO: 3202 - RNA, 19 nt, Homo sapiens
caggccugagcagauacca

SEQ ID NO: 3203 - RNA, 19 nt, Homo sapiens
gguaucugcucaggccuga

SEQ ID NO: 3204 - RNA, 19 nt, Homo sapiens
ucaggccugagcagauacc

SEQ ID NO: 3205 - RNA, 19 nt, Homo sapiens
guaucugcucaggccugag

SEQ ID NO: 3206 - RNA, 19 nt, Homo sapiens
cucaggccugagcagauac

SEQ ID NO: 3207 - RNA, 19 nt, Homo sapiens
uaucugcucaggccugagc

SEQ ID NO: 3208 - RNA, 19 nt, Homo sapiens
gcucaggccugagcagaua

SEQ ID NO: 3209 - RNA, 19 nt, Homo sapiens
aucugcucaggccugagca

SEQ ID NO: 3210 - RNA, 19 nt, Homo sapiens
ugcucaggccugagcagau

SEQ ID NO: 3211 - RNA, 19 nt, Homo sapiens
ucugcucaggccugagcau

SEQ ID NO: 3212 - RNA, 19 nt, Homo sapiens
augcucaggccugagcaga

SEQ ID NO: 3213 - RNA, 19 nt, Homo sapiens
cugcucaggccugagcaug

SEQ ID NO: 3214 - RNA, 19 nt, Homo sapiens
caugcucaggccugagcag

SEQ ID NO: 3215 - RNA, 19 nt, Homo sapiens
ugcucaggccugagcauga

SEQ ID NO: 3216 - RNA, 19 nt, Homo sapiens
ucaugcucaggccugagca

SEQ ID NO: 3217 - RNA, 19 nt, Homo sapiens
gcucaggccugagcaugac

SEQ ID NO: 3218 - RNA, 19 nt, Homo sapiens
gucaugcucaggccugagc

SEQ ID NO: 3219 - RNA, 19 nt, Homo sapiens
cucaggccugagcaugacc

SEQ ID NO: 3220 - RNA, 19 nt, Homo sapiens
ggucaugcucaggccugag

SEQ ID NO: 3221 - RNA, 19 nt, Homo sapiens
ucaggccugagcaugaccu

SEQ ID NO: 3222 - RNA, 19 nt, Homo sapiens
aggucaugcucaggccuga

SEQ ID NO: 3223 - RNA, 19 nt, Homo sapiens
caggccugagcaugaccuc

SEQ ID NO: 3224 - RNA, 19 nt, Homo sapiens
gaggucaugcucaggccug

SEQ ID NO: 3225 - RNA, 19 nt, Homo sapiens
aggccugagcaugaccuca

SEQ ID NO: 3226 - RNA, 19 nt, Homo sapiens
ugaggucaugcucaggccu

SEQ ID NO: 3227 - RNA, 19 nt, Homo sapiens
cacuuaaccccaggccauu

SEQ ID NO: 3228 - RNA, 19 nt, Homo sapiens
aauggccugggguuaagug

SEQ ID NO: 3229 - RNA, 19 nt, Homo sapiens
acuuaaccccaggccauua

SEQ ID NO: 3230 - RNA, 19 nt, Homo sapiens
uaauggccugggguuaagu

SEQ ID NO: 3231 - RNA, 19 nt, Homo sapiens
cuuaaccccaggccauuau

SEQ ID NO: 3232 - RNA, 19 nt, Homo sapiens
auaauggccugggguuaag

SEQ ID NO: 3233 - RNA, 19 nt, Homo sapiens
uuaaccccaggccauuauc

SEQ ID NO: 3234 - RNA, 19 nt, Homo sapiens
gauaauggccugggguuaa

SEQ ID NO: 3235 - RNA, 19 nt, Homo sapiens
uaaccccaggccauuauca

SEQ ID NO: 3236 - RNA, 19 nt, Homo sapiens
ugauaauggccugggguua

SEQ ID NO: 3237 - RNA, 19 nt, Homo sapiens
aaccccaggccauuaucau

SEQ ID NO: 3238 - RNA, 19 nt, Homo sapiens
augauaauggccugggguu

SEQ ID NO: 3239 - RNA, 19 nt, Homo sapiens
accccaggccauuaucaua

SEQ ID NO: 3240 - RNA, 19 nt, Homo sapiens
uaugauaauggccuggggu

SEQ ID NO: 3241 - RNA, 19 nt, Homo sapiens
cccaggccauuaucauauc

SEQ ID NO: 3242 - RNA, 19 nt, Homo sapiens
gauaugauaauggccuggg

SEQ ID NO: 3243 - RNA, 19 nt, Homo sapiens
ccaggccauuaucauaucc

SEQ ID NO: 3244 - RNA, 19 nt, Homo sapiens
ggauaugauaauggccugg

SEQ ID NO: 3245 - RNA, 19 nt, Homo sapiens
caggccauuaucauaucca

SEQ ID NO: 3246 - RNA, 19 nt, Homo sapiens
uggauaugauaauggccug

SEQ ID NO: 3247 - RNA, 19 nt, Homo sapiens
aggccauuaucauauccag

SEQ ID NO: 3248 - RNA, 19 nt, Homo sapiens
cuggauaugauaauggccu

SEQ ID NO: 3249 - RNA, 19 nt, Homo sapiens
ggccauuaucauauccaga

SEQ ID NO: 3250 - RNA, 19 nt, Homo sapiens
ucuggauaugauaauggcc

SEQ ID NO: 3251 - RNA, 19 nt, Homo sapiens
gccauuaucauauccagau

SEQ ID NO: 3252 - RNA, 19 nt, Homo sapiens
aucuggauaugauaauggc

SEQ ID NO: 3253 - RNA, 19 nt, Homo sapiens
cuucagaguugucuuuaua

SEQ ID NO: 3254 - RNA, 19 nt, Homo sapiens
uauaaagacaacucugaag

SEQ ID NO: 3255 - RNA, 19 nt, Homo sapiens
uucagaguugucuuuauau

SEQ ID NO: 3256 - RNA, 19 nt, Homo sapiens
auauaaagacaacucugaa

SEQ ID NO: 3257 - RNA, 19 nt, Homo sapiens
ucagaguugucuuuauaug

SEQ ID NO: 3258 - RNA, 19 nt, Homo sapiens
cauauaaagacaacucuga

SEQ ID NO: 3259 - RNA, 19 nt, Homo sapiens
agaguugucuuuauaugug

SEQ ID NO: 3260 - RNA, 19 nt, Homo sapiens
cacauauaaagacaacucu

SEQ ID NO: 3261 - RNA, 19 nt, Homo sapiens
uugucuuuauaugugaauu

SEQ ID NO: 3262 - RNA, 19 nt, Homo sapiens
aauucacauauaaagacaa

SEQ ID NO: 3263 - RNA, 19 nt, Homo sapiens
ugucuuuauaugugaauua

SEQ ID NO: 3264 - RNA, 19 nt, Homo sapiens
uaauucacauauaaagaca

SEQ ID NO: 3265 - RNA, 19 nt, Homo sapiens
gucuuuauaugugaauuaa

SEQ ID NO: 3266 - RNA, 19 nt, Homo sapiens
uuaauucacauauaaagac

SEQ ID NO: 3267 - RNA, 19 nt, Homo sapiens
ucuuuauaugugaauuaag

SEQ ID NO: 3268 - RNA, 19 nt, Homo sapiens
cuuaauucacauauaaaga

SEQ ID NO: 3269 - RNA, 19 nt, Homo sapiens
cuuuauaugugaauuaagu

SEQ ID NO: 3270 - RNA, 19 nt, Homo sapiens
acuuaauucacauauaaag

SEQ ID NO: 3271 - RNA, 19 nt, Homo sapiens
uuuauaugugaauuaaguu

SEQ ID NO: 3272 - RNA, 19 nt, Homo sapiens
aacuuaauucacauauaaa

SEQ ID NO: 3273 - RNA, 19 nt, Homo sapiens
uuauaugugaauuaaguua

SEQ ID NO: 3274 - RNA, 19 nt, Homo sapiens
uaacuuaauucacauauaa

SEQ ID NO: 3275 - RNA, 19 nt, Homo sapiens
uauaugugaauuaaguuau

SEQ ID NO: 3276 - RNA, 19 nt, Homo sapiens
auaacuuaauucacauaua

SEQ ID NO: 3277 - RNA, 19 nt, Homo sapiens
auaugugaauuaaguuaua

SEQ ID NO: 3278 - RNA, 19 nt, Homo sapiens
uauaacuuaauucacauau

SEQ ID NO: 3279 - RNA, 19 nt, Homo sapiens
uaugugaauuaaguuauau

SEQ ID NO: 3280 - RNA, 19 nt, Homo sapiens
auauaacuuaauucacaua

SEQ ID NO: 3281 - RNA, 19 nt, Homo sapiens
augugaauuaaguuauauu

SEQ ID NO: 3282 - RNA, 19 nt, Homo sapiens
aauauaacuuaauucacau

SEQ ID NO: 3283 - RNA, 19 nt, Homo sapiens
ugugaauuaaguuauauua

SEQ ID NO: 3284 - RNA, 19 nt, Homo sapiens
uaauauaacuuaauucaca

SEQ ID NO: 3285 - RNA, 19 nt, Homo sapiens
gugaauuaaguuauauuaa

SEQ ID NO: 3286 - RNA, 19 nt, Homo sapiens
uuaauauaacuuaauucac

SEQ ID NO: 3287 - RNA, 19 nt, Homo sapiens
ugaauuaaguuauauuaaa

SEQ ID NO: 3288 - RNA, 19 nt, Homo sapiens
uuuaauauaacuuaauuca

SEQ ID NO: 3289 - RNA, 19 nt, Homo sapiens
gaauuaaguuauauuaaau

SEQ ID NO: 3290 - RNA, 19 nt, Homo sapiens
auuuaauauaacuuaauuc

SEQ ID NO: 3291 - RNA, 19 nt, Homo sapiens
aauuaaguuauauuaaauu

SEQ ID NO: 3292 - RNA, 19 nt, Homo sapiens
aauuuaauauaacuuaauu

SEQ ID NO: 3293 - RNA, 19 nt, Homo sapiens
auuaaguuauauuaaauuu

SEQ ID NO: 3294 - RNA, 19 nt, Homo sapiens
aaauuuaauauaacuuaau

SEQ ID NO: 3295 - RNA, 19 nt, Homo sapiens
uuaaguuauauuaaauuuu

SEQ ID NO: 3296 - RNA, 19 nt, Homo sapiens
aaaauuuaauauaacuuaa

SEQ ID NO: 3297 - RNA, 19 nt, Homo sapiens
uaaguuauauuaaauuuua

SEQ ID NO: 3298 - RNA, 19 nt, Homo sapiens
uaaaauuuaauauaacuua

SEQ ID NO: 3299 - RNA, 19 nt, Homo sapiens
aaguuauauuaaauuuuaa

SEQ ID NO: 3300 - RNA, 19 nt, Homo sapiens
uuaaaauuuaauauaacuu

SEQ ID NO: 3301 - RNA, 19 nt, Homo sapiens
aguuauauuaaauuuuaau

SEQ ID NO: 3302 - RNA, 19 nt, Homo sapiens
auuaaaauuuaauauaacu

SEQ ID NO: 3303 - RNA, 19 nt, Homo sapiens
guuauauuaaauuuuaauc

SEQ ID NO: 3304 - RNA, 19 nt, Homo sapiens
gauuaaaauuuaauauaac

SEQ ID NO: 3305 - RNA, 19 nt, Homo sapiens
uauauuaaauuuuaaucua

SEQ ID NO: 3306 - RNA, 19 nt, Homo sapiens
uagauuaaaauuuaauaua

SEQ ID NO: 3307 - RNA, 19 nt, Homo sapiens
auauuaaauuuuaaucuau

SEQ ID NO: 3308 - RNA, 19 nt, Homo sapiens
auagauuaaaauuuaauau

SEQ ID NO: 3309 - RNA, 19 nt, Homo sapiens
uauuaaauuuuaaucuaua

SEQ ID NO: 3310 - RNA, 19 nt, Homo sapiens
uauagauuaaaauuuaaua

SEQ ID NO: 3311 - RNA, 19 nt, Homo sapiens
auuaaauuuuaaucuauag

SEQ ID NO: 3312 - RNA, 19 nt, Homo sapiens
cuauagauuaaaauuuaau

SEQ ID NO: 3313 - RNA, 19 nt, Homo sapiens
uuaaauuuuaaucuauagu

SEQ ID NO: 3314 - RNA, 19 nt, Homo sapiens
acuauagauuaaaauuuaa

SEQ ID NO: 3315 - RNA, 19 nt, Homo sapiens
uaaauuuuaaucuauagua

SEQ ID NO: 3316 - RNA, 19 nt, Homo sapiens
uacuauagauuaaaauuua

SEQ ID NO: 3317 - RNA, 19 nt, Homo sapiens
aaauuuuaaucuauaguaa

SEQ ID NO: 3318 - RNA, 19 nt, Homo sapiens
uuacuauagauuaaaauuu

SEQ ID NO: 3319 - RNA, 19 nt, Homo sapiens
uuuuaaucuauaguaaaaa

SEQ ID NO: 3320 - RNA, 19 nt, Homo sapiens
uuuuuacuauagauuaaaa

SEQ ID NO: 3321 - RNA, 19 nt, Homo sapiens
uuuaaucuauaguaaaaac

SEQ ID NO: 3322 - RNA, 19 nt, Homo sapiens
guuuuuacuauagauuaaa

SEQ ID NO: 3323 - RNA, 19 nt, Homo sapiens
uuaaucuauaguaaaaaca

SEQ ID NO: 3324 - RNA, 19 nt, Homo sapiens
uguuuuuacuauagauuaa

SEQ ID NO: 3325 - RNA, 19 nt, Homo sapiens
uaaucuauaguaaaaacau

SEQ ID NO: 3326 - RNA, 19 nt, Homo sapiens
auguuuuuacuauagauua

SEQ ID NO: 3327 - RNA, 19 nt, Homo sapiens
aaucuauaguaaaaacaua

SEQ ID NO: 3328 - RNA, 19 nt, Homo sapiens
uauguuuuuacuauagauu

SEQ ID NO: 3329 - RNA, 19 nt, Homo sapiens
aucuauaguaaaaacauag

SEQ ID NO: 3330 - RNA, 19 nt, Homo sapiens
cuauguuuuuacuauagau

SEQ ID NO: 3331 - RNA, 19 nt, Homo sapiens
ucuauaguaaaaacauagu

SEQ ID NO: 3332 - RNA, 19 nt, Homo sapiens
acuauguuuuuacuauaga

SEQ ID NO: 3333 - RNA, 19 nt, Homo sapiens
cuauaguaaaaacauaguc

SEQ ID NO: 3334 - RNA, 19 nt, Homo sapiens
gacuauguuuuuacuauag

SEQ ID NO: 3335 - RNA, 19 nt, Homo sapiens
uauaguaaaaacauagucc

SEQ ID NO: 3336 - RNA, 19 nt, Homo sapiens
ggacuauguuuuuacuaua

SEQ ID NO: 3337 - RNA, 19 nt, Homo sapiens
auaguaaaaacauaguccu

SEQ ID NO: 3338 - RNA, 19 nt, Homo sapiens
aggacuauguuuuuacuau

SEQ ID NO: 3339 - RNA, 19 nt, Homo sapiens
uaguaaaaacauaguccug

SEQ ID NO: 3340 - RNA, 19 nt, Homo sapiens
caggacuauguuuuuacua

SEQ ID NO: 3341 - RNA, 19 nt, Homo sapiens
aguaaaaacauaguccugg

SEQ ID NO: 3342 - RNA, 19 nt, Homo sapiens
ccaggacuauguuuuuacu

SEQ ID NO: 3343 - RNA, 19 nt, Homo sapiens
guaaaaacauaguccugga

SEQ ID NO: 3344 - RNA, 19 nt, Homo sapiens
uccaggacuauguuuuuac

SEQ ID NO: 3345 - RNA, 19 nt, Homo sapiens
uaaaaacauaguccuggaa

SEQ ID NO: 3346 - RNA, 19 nt, Homo sapiens
uuccaggacuauguuuuua

SEQ ID NO: 3347 - RNA, 19 nt, Homo sapiens
aaaaacauaguccuggaaa

SEQ ID NO: 3348 - RNA, 19 nt, Homo sapiens
uuuccaggacuauguuuuu

SEQ ID NO: 3349 - RNA, 19 nt, Homo sapiens
aaaacauaguccuggaaau

SEQ ID NO: 3350 - RNA, 19 nt, Homo sapiens
auuuccaggacuauguuuu

SEQ ID NO: 3351 - RNA, 19 nt, Homo sapiens
aaacauaguccuggaaaua

SEQ ID NO: 3352 - RNA, 19 nt, Homo sapiens
uauuuccaggacuauguuu

SEQ ID NO: 3353 - RNA, 19 nt, Homo sapiens
aacauaguccuggaaauaa

SEQ ID NO: 3354 - RNA, 19 nt, Homo sapiens
uuauuuccaggacuauguu

SEQ ID NO: 3355 - RNA, 19 nt, Homo sapiens
acauaguccuggaaauaaa

SEQ ID NO: 3356 - RNA, 19 nt, Homo sapiens
uuuauuuccaggacuaugu

SEQ ID NO: 3357 - RNA, 19 nt, Homo sapiens
cauaguccuggaaauaaau

SEQ ID NO: 3358 - RNA, 19 nt, Homo sapiens
auuuauuuccaggacuaug

SEQ ID NO: 3359 - RNA, 19 nt, Homo sapiens
auaguccuggaaauaaauu

SEQ ID NO: 3360 - RNA, 19 nt, Homo sapiens
aauuuauuuccaggacuau

SEQ ID NO: 3361 - RNA, 19 nt, Homo sapiens
uaguccuggaaauaaauuc

SEQ ID NO: 3362 - RNA, 19 nt, Homo sapiens
gaauuuauuuccaggacua

SEQ ID NO: 3363 - RNA, 19 nt, Homo sapiens
guccuggaaauaaauucuu

SEQ ID NO: 3364 - RNA, 19 nt, Homo sapiens
aagaauuuauuuccaggac

SEQ ID NO: 3365 - RNA, 19 nt, Homo sapiens
uccuggaaauaaauucuug

SEQ ID NO: 3366 - RNA, 19 nt, Homo sapiens
caagaauuuauuuccagga

SEQ ID NO: 3367 - protein, 16 aa, Artificial Sequence
  source: /note="Description of Artificial Sequence: Synthetic peptide"
AAVALLPAVLLALLAP

SEQ ID NO: 3368 - protein, 11 aa, Artificial Sequence
  source: /note="Description of Artificial Sequence: Synthetic peptide"
AALLPVLLAAP

SEQ ID NO: 3369 - protein, 13 aa, Human immunodeficiency virus 1
GRKKRRQRRRPPQ

SEQ ID NO: 3370 - protein, 16 aa, Drosophila sp.
RQIKIWFQNRRMKWKK

SEQ ID NO: 3371 - RNA, 21 nt, Artificial Sequence
  source: /note="Description of Artificial Sequence: Synthetic oligonucleotide"
caugccaaaaauggacaucau

SEQ ID NO: 3372 - RNA, 23 nt, Artificial Sequence
  source: /note="Description of Artificial Sequence: Synthetic oligonucleotide"
augauguccauuuuuggcaugac

SEQ ID NO: 3373 - RNA, 21 nt, Artificial Sequence
  source: /note="Description of Artificial Sequence: Synthetic oligonucleotide"
auuuugaagugaugagugaaa

SEQ ID NO: 3374 - RNA, 23 nt, Artificial Sequence
  source: /note="Description of Artificial Sequence: Synthetic oligonucleotide"
uuucacucaucacuucaaaaugc

SEQ ID NO: 3375 - RNA, 21 nt, Artificial Sequence
  source: /note="Description of Artificial Sequence: Synthetic oligonucleotide"
aguuauauuaaauuuuaaucu

SEQ ID NO: 3376 - RNA, 23 nt, Artificial Sequence
  source: /note="Description of Artificial Sequence: Synthetic oligonucleotide"
agauuaaaauuuaauauaacuua

SEQ ID NO: 3377 - RNA, 21 nt, Artificial Sequence
  source: /note="Description of Artificial Sequence: Synthetic oligonucleotide"
gcauuuugaagugaugaguga

SEQ ID NO: 3378 - RNA, 23 nt, Artificial Sequence
  source: /note="Description of Artificial Sequence: Synthetic oligonucleotide"
ucacucaucacuucaaaaugcag

SEQ ID NO: 3379 - RNA, 21 nt, Artificial Sequence
  source: /note="Description of Artificial Sequence: Synthetic oligonucleotide"
gaacuaaugagcagacauaac

SEQ ID NO: 3380 - RNA, 23 nt, Artificial Sequence
  source: /note="Description of Artificial Sequence: Synthetic oligonucleotide"
guuaugucugcucauuaguucau

SEQ ID NO: 3381 - RNA, 21 nt, Artificial Sequence
  source: /note="Description of Artificial Sequence: Synthetic oligonucleotide"
aaugaccacaccuaucgaguu

SEQ ID NO: 3382 - RNA, 23 nt, Artificial Sequence
  source: /note="Description of Artificial Sequence: Synthetic oligonucleotide"
aacucgauagguguggucauucu

SEQ ID NO: 3383 - RNA, 21 nt, Artificial Sequence
  source: /note="Description of Artificial Sequence: Synthetic oligonucleotide"
uaaauuuuaaucuauaguaaa

SEQ ID NO: 3384 - RNA, 23 nt, Artificial Sequence
  source: /note="Description of Artificial Sequence: Synthetic oligonucleotide"
uuuacuauagauuaaaauuuaau

SEQ ID NO: 3385 - RNA, 21 nt, Artificial Sequence
  source: /note="Description of Artificial Sequence: Synthetic oligonucleotide"
uucaguaugaucguuucuuug

SEQ ID NO: 3386 - RNA, 23 nt, Artificial Sequence
  source: /note="Description of Artificial Sequence: Synthetic oligonucleotide"
caaagaaacgaucauacugaaaa

SEQ ID NO: 3387 - RNA, 21 nt, Artificial Sequence
  source: /note="Description of Artificial Sequence: Synthetic oligonucleotide"
cacuuuucaguaugaucguuu

SEQ ID NO: 3388 - RNA, 23 nt, Artificial Sequence
  source: /note="Description of Artificial Sequence: Synthetic oligonucleotide"
aaacgaucauacugaaaagugga

SEQ ID NO: 3389 - RNA, 21 nt, Artificial Sequence
  source: /note="Description of Artificial Sequence: Synthetic oligonucleotide"
aaaucuguuuccacuuuucag

SEQ ID NO: 3390 - RNA, 23 nt, Artificial Sequence
  source: /note="Description of Artificial Sequence: Synthetic oligonucleotide"
cugaaaaguggaaacagauuuug

SEQ ID NO: 3391 - RNA, 21 nt, Artificial Sequence
  source: /note="Description of Artificial Sequence: Synthetic oligonucleotide"
cauuugaaacuguccauucaa

SEQ ID NO: 3392 - RNA, 23 nt, Artificial Sequence
  source: /note="Description of Artificial Sequence: Synthetic oligonucleotide"
uugaauggacaguuucaaaugcc

SEQ ID NO: 3393 - RNA, 21 nt, Artificial Sequence
  source: /note="Description of Artificial Sequence: Synthetic oligonucleotide"
ccuaucgaguuuuuaaaacug

SEQ ID NO: 3394 - RNA, 23 nt, Artificial Sequence
  source: /note="Description of Artificial Sequence: Synthetic oligonucleotide"
caguuuuaaaaacucgauaggug

SEQ ID NO: 3395 - RNA, 21 nt, Artificial Sequence
  source: /note="Description of Artificial Sequence: Synthetic oligonucleotide"
gaccagaaagagugucucauc

SEQ ID NO: 3396 - RNA, 23 nt, Artificial Sequence
  source: /note="Description of Artificial Sequence: Synthetic oligonucleotide"
gaugagacacucuuucuggucuu

SEQ ID NO: 3397 - RNA, 21 nt, Artificial Sequence
  source: /note="Description of Artificial Sequence: Synthetic oligonucleotide"
accagaaagagugucucaucu

SEQ ID NO: 3398 - RNA, 23 nt, Artificial Sequence
  source: /note="Description of Artificial Sequence: Synthetic oligonucleotide"
agaugagacacucuuucuggucu

SEQ ID NO: 3399 - RNA, 21 nt, Artificial Sequence
  source: /note="Description of Artificial Sequence: Synthetic oligonucleotide"
acuaaugagcagacauaacau

SEQ ID NO: 3400 - RNA, 23 nt, Artificial Sequence
  source: /note="Description of Artificial Sequence: Synthetic oligonucleotide"
auguuaugucugcucauuaguuc

SEQ ID NO: 3401 - RNA, 21 nt, Artificial Sequence
  source: /note="Description of Artificial Sequence: Synthetic oligonucleotide"
uaguaaaaacauaguccugga

SEQ ID NO: 3402 - RNA, 23 nt, Artificial Sequence
  source: /note="Description of Artificial Sequence: Synthetic oligonucleotide"
uccaggacuauguuuuuacuaua

SEQ ID NO: 3403 - RNA, 21 nt, Artificial Sequence
  source: /note="Description of Artificial Sequence: Synthetic oligonucleotide"
uauuucuggaacuaguaaauu

SEQ ID NO: 3404 - RNA, 23 nt, Artificial Sequence
  source: /note="Description of Artificial Sequence: Synthetic oligonucleotide"
aauuuacuaguuccagaaauauu

SEQ ID NO: 3405 - RNA, 21 nt, Artificial Sequence
  source: /note="Description of Artificial Sequence: Synthetic oligonucleotide"
uucugcaaagccagucuugag

SEQ ID NO: 3406 - RNA, 23 nt, Artificial Sequence
  source: /note="Description of Artificial Sequence: Synthetic oligonucleotide"
cucaagacuggcuuugcagaaga

SEQ ID NO: 3407 - RNA, 21 nt, Artificial Sequence
  source: /note="Description of Artificial Sequence: Synthetic oligonucleotide"
gaggaaagagguugcugaaac

SEQ ID NO: 3408 - RNA, 23 nt, Artificial Sequence
  source: /note="Description of Artificial Sequence: Synthetic oligonucleotide"
guuucagcaaccucuuuccucac

SEQ ID NO: 3409 - RNA, 21 nt, Artificial Sequence
  source: /note="Description of Artificial Sequence: Synthetic oligonucleotide"
gguacuagaaauauuucugga

SEQ ID NO: 3410 - RNA, 23 nt, Artificial Sequence
  source: /note="Description of Artificial Sequence: Synthetic oligonucleotide"
uccagaaauauuucuaguaccac

SEQ ID NO: 3411 - RNA, 21 nt, Artificial Sequence
  source: /note="Description of Artificial Sequence: Synthetic oligonucleotide"
gacaucaugcaaaagcaaaga

SEQ ID NO: 3412 - RNA, 23 nt, Artificial Sequence
  source: /note="Description of Artificial Sequence: Synthetic oligonucleotide"
ucuuugcuuuugcaugauguccu

SEQ ID NO: 3413 - RNA, 21 nt, Artificial Sequence
  source: /note="Description of Artificial Sequence: Synthetic oligonucleotide"
aaauuuuaaucuauaguaaaa

SEQ ID NO: 3414 - RNA, 23 nt, Artificial Sequence
  source: /note="Description of Artificial Sequence: Synthetic oligonucleotide"
uuuuacuauagauuaaaauuuaa

SEQ ID NO: 3415 - RNA, 21 nt, Artificial Sequence
  source: /note="Description of Artificial Sequence: Synthetic oligonucleotide"
caugauccaagggauucgaaa

SEQ ID NO: 3416 - RNA, 23 nt, Artificial Sequence
  source: /note="Description of Artificial Sequence: Synthetic oligonucleotide"
uuucgaaucccuuggaucaugga

SEQ ID NO: 3417 - RNA, 21 nt, Artificial Sequence
  source: /note="Description of Artificial Sequence: Synthetic oligonucleotide"
agaccagaaagagugucucau

SEQ ID NO: 3418 - RNA, 23 nt, Artificial Sequence
  source: /note="Description of Artificial Sequence: Synthetic oligonucleotide"
augagacacucuuucuggucuuu

SEQ ID NO: 3419 - RNA, 21 nt, Artificial Sequence
  source: /note="Description of Artificial Sequence: Synthetic oligonucleotide"
auccugaagagcgcugaggga

SEQ ID NO: 3420 - RNA, 23 nt, Artificial Sequence
  source: /note="Description of Artificial Sequence: Synthetic oligonucleotide"
ucccucagcgcucuucaggaucc

SEQ ID NO: 3421 - RNA, 21 nt, Artificial Sequence
  source: /note="Description of Artificial Sequence: Synthetic oligonucleotide"
gucugugaugaacuaaugagc

SEQ ID NO: 3422 - RNA, 23 nt, Artificial Sequence
  source: /note="Description of Artificial Sequence: Synthetic oligonucleotide"
gcucauuaguucaucacagacuu

SEQ ID NO: 3423 - RNA, 21 nt, Artificial Sequence
  source: /note="Description of Artificial Sequence: Synthetic oligonucleotide"
cagaaagagugucucaucuuc

SEQ ID NO: 3424 - RNA, 23 nt, Artificial Sequence
  source: /note="Description of Artificial Sequence: Synthetic oligonucleotide"
gaagaugagacacucuuucuggu

SEQ ID NO: 3425 - RNA, 21 nt, Artificial Sequence
  source: /note="Description of Artificial Sequence: Synthetic oligonucleotide"
acuuuucaguaugaucguuuc

SEQ ID NO: 3426 - RNA, 23 nt, Artificial Sequence
  source: /note="Description of Artificial Sequence: Synthetic oligonucleotide"
gaaacgaucauacugaaaagugg

SEQ ID NO: 3427 - RNA, 21 nt, Artificial Sequence
  source: /note="Description of Artificial Sequence: Synthetic oligonucleotide"
ucaugccaaaaauggacauca

SEQ ID NO: 3428 - RNA, 23 nt, Artificial Sequence
  source: /note="Description of Artificial Sequence: Synthetic oligonucleotide"
ugauguccauuuuuggcaugacu

SEQ ID NO: 3429 - RNA, 21 nt, Artificial Sequence
  source: /note="Description of Artificial Sequence: Synthetic oligonucleotide"
aauauuucuggaacuaguaaa

SEQ ID NO: 3430 - RNA, 23 nt, Artificial Sequence
  source: /note="Description of Artificial Sequence: Synthetic oligonucleotide"
uuuacuaguuccagaaauauuuc

SEQ ID NO: 3431 - RNA, 21 nt, Artificial Sequence
  source: /note="Description of Artificial Sequence: Synthetic oligonucleotide"
cuucuucaagauaacuugcca

SEQ ID NO: 3432 - RNA, 23 nt, Artificial Sequence
  source: /note="Description of Artificial Sequence: Synthetic oligonucleotide"
uggcaaguuaucuugaagaagau

SEQ ID NO: 3433 - RNA, 21 nt, Artificial Sequence
  source: /note="Description of Artificial Sequence: Synthetic oligonucleotide"
uuucaguaugaucguuucuuu

SEQ ID NO: 3434 - RNA, 23 nt, Artificial Sequence
  source: /note="Description of Artificial Sequence: Synthetic oligonucleotide"
aaagaaacgaucauacugaaaag

SEQ ID NO: 3435 - RNA, 21 nt, Artificial Sequence
  source: /note="Description of Artificial Sequence: Synthetic oligonucleotide"
cccagugugguuagugugaaa

SEQ ID NO: 3436 - RNA, 23 nt, Artificial Sequence
  source: /note="Description of Artificial Sequence: Synthetic oligonucleotide"
uuucacacuaaccacacuggggc

SEQ ID NO: 3437 - RNA, 21 nt, Artificial Sequence
  source: /note="Description of Artificial Sequence: Synthetic oligonucleotide"
gcugugagauuuacucugauu

SEQ ID NO: 3438 - RNA, 23 nt, Artificial Sequence
  source: /note="Description of Artificial Sequence: Synthetic oligonucleotide"
aaucagaguaaaucucacagccu

SEQ ID NO: 3439 - RNA, 21 nt, Artificial Sequence
  source: /note="Description of Artificial Sequence: Synthetic oligonucleotide"
aggcuugagcaaguugguauc

SEQ ID NO: 3440 - RNA, 23 nt, Artificial Sequence
  source: /note="Description of Artificial Sequence: Synthetic oligonucleotide"
gauaccaacuugcucaagccuga

SEQ ID NO: 3441 - RNA, 21 nt, Artificial Sequence
  source: /note="Description of Artificial Sequence: Synthetic oligonucleotide"
gaaagagugucucaucuucuu

SEQ ID NO: 3442 - RNA, 23 nt, Artificial Sequence
  source: /note="Description of Artificial Sequence: Synthetic oligonucleotide"
aagaagaugagacacucuuucug

SEQ ID NO: 3443 - RNA, 21 nt, Artificial Sequence
  source: /note="Description of Artificial Sequence: Synthetic oligonucleotide"
auuucuggaacuaguaaauuc

SEQ ID NO: 3444 - RNA, 23 nt, Artificial Sequence
  source: /note="Description of Artificial Sequence: Synthetic oligonucleotide"
gaauuuacuaguuccagaaauau

SEQ ID NO: 3445 - RNA, 21 nt, Artificial Sequence
  source: /note="Description of Artificial Sequence: Synthetic oligonucleotide"
ugugauguggcccaugaguuu

SEQ ID NO: 3446 - RNA, 23 nt, Artificial Sequence
  source: /note="Description of Artificial Sequence: Synthetic oligonucleotide"
aaacucaugggccacaucacaca

SEQ ID NO: 3447 - RNA, 21 nt, Artificial Sequence
  source: /note="Description of Artificial Sequence: Synthetic oligonucleotide"
aagagagaaguccuauuucuc

SEQ ID NO: 3448 - RNA, 23 nt, Artificial Sequence
  source: /note="Description of Artificial Sequence: Synthetic oligonucleotide"
gagaaauaggacuucucucuuuc

SEQ ID NO: 3449 - RNA, 21 nt, Artificial Sequence
  source: /note="Description of Artificial Sequence: Synthetic oligonucleotide"
uggcagcacagaugaaucaga

SEQ ID NO: 3450 - RNA, 23 nt, Artificial Sequence
  source: /note="Description of Artificial Sequence: Synthetic oligonucleotide"
ucugauucaucugugcugccagg

SEQ ID NO: 3451 - RNA, 21 nt, Artificial Sequence
  source: /note="Description of Artificial Sequence: Synthetic oligonucleotide"
augaucguuucuuugagaaaa

SEQ ID NO: 3452 - RNA, 23 nt, Artificial Sequence
  source: /note="Description of Artificial Sequence: Synthetic oligonucleotide"
uuuucucaaagaaacgaucauac

SEQ ID NO: 3453 - RNA, 21 nt, Artificial Sequence
  source: /note="Description of Artificial Sequence: Synthetic oligonucleotide"
ucuggaacuaguaaauuccau

SEQ ID NO: 3454 - RNA, 23 nt, Artificial Sequence
  source: /note="Description of Artificial Sequence: Synthetic oligonucleotide"
auggaauuuacuaguuccagaaa

SEQ ID NO: 3455 - RNA, 19 nt, Artificial Sequence
  source: /note="Description of Artificial Sequence: Synthetic oligonucleotide"
gcccauucuuaucccgagu

SEQ ID NO: 3456 - RNA, 19 nt, Artificial Sequence
  source: /note="Description of Artificial Sequence: Synthetic oligonucleotide"
acucgggauaagaaugggc

SEQ ID NO: 3457 - RNA, 19 nt, Artificial Sequence
  source: /note="Description of Artificial Sequence: Synthetic oligonucleotide"
ggaaccaugccuccaugau

SEQ ID NO: 3458 - RNA, 19 nt, Artificial Sequence
  source: /note="Description of Artificial Sequence: Synthetic oligonucleotide"
aucauggaggcaugguucc

SEQ ID NO: 3459 - RNA, 19 nt, Artificial Sequence
  source: /note="Description of Artificial Sequence: Synthetic oligonucleotide"
uggagucugugcggauccu

SEQ ID NO: 3460 - RNA, 19 nt, Artificial Sequence
  source: /note="Description of Artificial Sequence: Synthetic oligonucleotide"
aggauccgcacagacucca

SEQ ID NO: 3461 - RNA, 19 nt, Artificial Sequence
  source: /note="Description of Artificial Sequence: Synthetic oligonucleotide"
cacccacggguguguggga

SEQ ID NO: 3462 - RNA, 19 nt, Artificial Sequence
  source: /note="Description of Artificial Sequence: Synthetic oligonucleotide"
ucccacacacccgugggug

SEQ ID NO: 3463 - RNA, 19 nt, Artificial Sequence
  source: /note="Description of Artificial Sequence: Synthetic oligonucleotide"
ggagucugugcggauccua

SEQ ID NO: 3464 - RNA, 19 nt, Artificial Sequence
  source: /note="Description of Artificial Sequence: Synthetic oligonucleotide"
uaggauccgcacagacucc

SEQ ID NO: 3465 - RNA, 19 nt, Artificial Sequence
  source: /note="Description of Artificial Sequence: Synthetic oligonucleotide"
caaaacugccccaagauga

SEQ ID NO: 3466 - RNA, 19 nt, Artificial Sequence
  source: /note="Description of Artificial Sequence: Synthetic oligonucleotide"
ucaucuuggggcaguuuug

SEQ ID NO: 3467 - RNA, 19 nt, Artificial Sequence
  source: /note="Description of Artificial Sequence: Synthetic oligonucleotide"
gccuccaugauccaaggga

SEQ ID NO: 3468 - RNA, 19 nt, Artificial Sequence
  source: /note="Description of Artificial Sequence: Synthetic oligonucleotide"
ucccuuggaucauggaggc

SEQ ID NO: 3469 - RNA, 19 nt, Artificial Sequence
  source: /note="Description of Artificial Sequence: Synthetic oligonucleotide"
caucaucccugugcggguu

SEQ ID NO: 3470 - RNA, 19 nt, Artificial Sequence
  source: /note="Description of Artificial Sequence: Synthetic oligonucleotide"
aacccgcacagggaugaug

SEQ ID NO: 3471 - RNA, 19 nt, Artificial Sequence
  source: /note="Description of Artificial Sequence: Synthetic oligonucleotide"
acccacgggugugugggga

SEQ ID NO: 3472 - RNA, 19 nt, Artificial Sequence
  source: /note="Description of Artificial Sequence: Synthetic oligonucleotide"
uccccacacacccgugggu

SEQ ID NO: 3473 - RNA, 19 nt, Artificial Sequence
  source: /note="Description of Artificial Sequence: Synthetic oligonucleotide"
cacaucaucccugugcgga

SEQ ID NO: 3474 - RNA, 19 nt, Artificial Sequence
  source: /note="Description of Artificial Sequence: Synthetic oligonucleotide"
uccgcacagggaugaugug

SEQ ID NO: 3475 - RNA, 19 nt, Artificial Sequence
  source: /note="Description of Artificial Sequence: Synthetic oligonucleotide"
cagaaagagugucucaucu

SEQ ID NO: 3476 - RNA, 19 nt, Artificial Sequence
  source: /note="Description of Artificial Sequence: Synthetic oligonucleotide"
agaugagacacucuuucug

SEQ ID NO: 3477 - RNA, 19 nt, Artificial Sequence
  source: /note="Description of Artificial Sequence: Synthetic oligonucleotide"
ccuccaugauccaagggau

SEQ ID NO: 3478 - RNA, 19 nt, Artificial Sequence
  source: /note="Description of Artificial Sequence: Synthetic oligonucleotide"
aucccuuggaucauggagg

SEQ ID NO: 3479 - RNA, 19 nt, Artificial Sequence
  source: /note="Description of Artificial Sequence: Synthetic oligonucleotide"
ugcccauucuuaucccgaa

SEQ ID NO: 3480 - RNA, 19 nt, Artificial Sequence
  source: /note="Description of Artificial Sequence: Synthetic oligonucleotide"
uucgggauaagaaugggca

SEQ ID NO: 3481 - RNA, 19 nt, Artificial Sequence
  source: /note="Description of Artificial Sequence: Synthetic oligonucleotide"
cuucacccuggcuaagaua

SEQ ID NO: 3482 - RNA, 19 nt, Artificial Sequence
  source: /note="Description of Artificial Sequence: Synthetic oligonucleotide"
uaucuuagccagggugaag

SEQ ID NO: 3483 - RNA, 19 nt, Artificial Sequence
  source: /note="Description of Artificial Sequence: Synthetic oligonucleotide"
aucaucccugugcggguua

SEQ ID NO: 3484 - RNA, 19 nt, Artificial Sequence
  source: /note="Description of Artificial Sequence: Synthetic oligonucleotide"
uaacccgcacagggaugau

SEQ ID NO: 3485 - RNA, 19 nt, Artificial Sequence
  source: /note="Description of Artificial Sequence: Synthetic oligonucleotide"
agaaagagugucucaucuu

SEQ ID NO: 3486 - RNA, 19 nt, Artificial Sequence
  source: /note="Description of Artificial Sequence: Synthetic oligonucleotide"
aagaugagacacucuuucu

SEQ ID NO: 3487 - RNA, 19 nt, Artificial Sequence
  source: /note="Description of Artificial Sequence: Synthetic oligonucleotide"
cuccaugauccaagggauu

SEQ ID NO: 3488 - RNA, 19 nt, Artificial Sequence
  source: /note="Description of Artificial Sequence: Synthetic oligonucleotide"
aaucccuuggaucauggag

SEQ ID NO: 3489 - RNA, 19 nt, Artificial Sequence
  source: /note="Description of Artificial Sequence: Synthetic oligonucleotide"
ccauucuuaucccgaguca

SEQ ID NO: 3490 - RNA, 19 nt, Artificial Sequence
  source: /note="Description of Artificial Sequence: Synthetic oligonucleotide"
ugacucgggauaagaaugg

SEQ ID NO: 3491 - RNA, 19 nt, Artificial Sequence
  source: /note="Description of Artificial Sequence: Synthetic oligonucleotide"
cacccuggcuaagaugaua

SEQ ID NO: 3492 - RNA, 19 nt, Artificial Sequence
  source: /note="Description of Artificial Sequence: Synthetic oligonucleotide"
uaucaucuuagccagggug

SEQ ID NO: 3493 - RNA, 19 nt, Artificial Sequence
  source: /note="Description of Artificial Sequence: Synthetic oligonucleotide"
ucaucccugugcggguuga

SEQ ID NO: 3494 - RNA, 19 nt, Artificial Sequence
  source: /note="Description of Artificial Sequence: Synthetic oligonucleotide"
ucaacccgcacagggauga

SEQ ID NO: 3495 - RNA, 19 nt, Artificial Sequence
  source: /note="Description of Artificial Sequence: Synthetic oligonucleotide"
aagagugucucaucuucuu

SEQ ID NO: 3496 - RNA, 19 nt, Artificial Sequence
  source: /note="Description of Artificial Sequence: Synthetic oligonucleotide"
aagaagaugagacacucuu

SEQ ID NO: 3497 - RNA, 19 nt, Artificial Sequence
  source: /note="Description of Artificial Sequence: Synthetic oligonucleotide"
gucaugccaaaaauggaca

SEQ ID NO: 3498 - RNA, 19 nt, Artificial Sequence
  source: /note="Description of Artificial Sequence: Synthetic oligonucleotide"
uguccauuuuuggcaugac

SEQ ID NO: 3499 - RNA, 19 nt, Artificial Sequence
  source: /note="Description of Artificial Sequence: Synthetic oligonucleotide"
cauucuuaucccgagucca

SEQ ID NO: 3500 - RNA, 19 nt, Artificial Sequence
  source: /note="Description of Artificial Sequence: Synthetic oligonucleotide"
uggacucgggauaagaaug

SEQ ID NO: 3501 - RNA, 19 nt, Artificial Sequence
  source: /note="Description of Artificial Sequence: Synthetic oligonucleotide"
acccuggcuaagaugauga

SEQ ID NO: 3502 - RNA, 19 nt, Artificial Sequence
  source: /note="Description of Artificial Sequence: Synthetic oligonucleotide"
ucaucaucuuagccagggu

SEQ ID NO: 3503 - RNA, 19 nt, Artificial Sequence
  source: /note="Description of Artificial Sequence: Synthetic oligonucleotide"
cucuucacccuggcuaaga

SEQ ID NO: 3504 - RNA, 19 nt, Artificial Sequence
  source: /note="Description of Artificial Sequence: Synthetic oligonucleotide"
ucuuagccagggugaagag

SEQ ID NO: 3505 - RNA, 19 nt, Artificial Sequence
  source: /note="Description of Artificial Sequence: Synthetic oligonucleotide"
augccaaaaauggacauca

SEQ ID NO: 3506 - RNA, 19 nt, Artificial Sequence
  source: /note="Description of Artificial Sequence: Synthetic oligonucleotide"
ugauguccauuuuuggcau

SEQ ID NO: 3507 - RNA, 19 nt, Artificial Sequence
  source: /note="Description of Artificial Sequence: Synthetic oligonucleotide"
ugccccaagaugauggaau

SEQ ID NO: 3508 - RNA, 19 nt, Artificial Sequence
  source: /note="Description of Artificial Sequence: Synthetic oligonucleotide"
auuccaucaucuuggggca

SEQ ID NO: 3509 - RNA, 19 nt, Artificial Sequence
  source: /note="Description of Artificial Sequence: Synthetic oligonucleotide"
gaaccaugccuccaugaua

SEQ ID NO: 3510 - RNA, 19 nt, Artificial Sequence
  source: /note="Description of Artificial Sequence: Synthetic oligonucleotide"
uaucauggaggcaugguuc

SEQ ID NO: 3511 - RNA, 19 nt, Artificial Sequence
  source: /note="Description of Artificial Sequence: Synthetic oligonucleotide"
ucuucacccuggcuaagau

SEQ ID NO: 3512 - RNA, 19 nt, Artificial Sequence
  source: /note="Description of Artificial Sequence: Synthetic oligonucleotide"
aucuuagccagggugaaga

SEQ ID NO: 3513 - RNA, 19 nt, Artificial Sequence
  source: /note="Description of Artificial Sequence: Synthetic oligonucleotide"
ugccaaaaauggacaucau

SEQ ID NO: 3514 - RNA, 19 nt, Artificial Sequence
  source: /note="Description of Artificial Sequence: Synthetic oligonucleotide"
augauguccauuuuuggca

SEQ ID NO: 3515 - RNA, 19 nt, Artificial Sequence
  source: /note="Description of Artificial Sequence: Synthetic oligonucleotide"
ccagaaagagugucucaua

SEQ ID NO: 3516 - RNA, 19 nt, Artificial Sequence
  source: /note="Description of Artificial Sequence: Synthetic oligonucleotide"
uaugagacacucuuucugg

SEQ ID NO: 3517 - RNA, 19 nt, Artificial Sequence
  source: /note="Description of Artificial Sequence: Synthetic oligonucleotide"
gaaacuguccauucaauga

SEQ ID NO: 3518 - RNA, 19 nt, Artificial Sequence
  source: /note="Description of Artificial Sequence: Synthetic oligonucleotide"
ucauugaauggacaguuuc

SEQ ID NO: 3519 - RNA, 19 nt, Artificial Sequence
  source: /note="Description of Artificial Sequence: Synthetic oligonucleotide"
ucacccuggcuaagaugau

SEQ ID NO: 3520 - RNA, 19 nt, Artificial Sequence
  source: /note="Description of Artificial Sequence: Synthetic oligonucleotide"
aucaucuuagccaggguga

SEQ ID NO: 3521 - RNA, 19 nt, Artificial Sequence
  source: /note="Description of Artificial Sequence: Synthetic oligonucleotide"
cccuggagucugugcggau

SEQ ID NO: 3522 - RNA, 19 nt, Artificial Sequence
  source: /note="Description of Artificial Sequence: Synthetic oligonucleotide"
auccgcacagacuccaggg

SEQ ID NO: 3523 - RNA, 19 nt, Artificial Sequence
  source: /note="Description of Artificial Sequence: Synthetic oligonucleotide"
gaaagagugucucaucuua

SEQ ID NO: 3524 - RNA, 19 nt, Artificial Sequence
  source: /note="Description of Artificial Sequence: Synthetic oligonucleotide"
uaagaugagacacucuuuc

SEQ ID NO: 3525 - RNA, 19 nt, Artificial Sequence
  source: /note="Description of Artificial Sequence: Synthetic oligonucleotide"
uggagcccuggagucugua

SEQ ID NO: 3526 - RNA, 19 nt, Artificial Sequence
  source: /note="Description of Artificial Sequence: Synthetic oligonucleotide"
uacagacuccagggcucca

SEQ ID NO: 3527 - RNA, 23 nt, Homo sapiens
augauguccauuuuuggcaugac

SEQ ID NO: 3528 - RNA, 21 nt, Homo sapiens
auuuugaagugaugagugaaa

SEQ ID NO: 3529 - RNA, 23 nt, Homo sapiens
uuucacucaucacuucaaaaugc

SEQ ID NO: 3530 - RNA, 21 nt, Homo sapiens
aguuauauuaaauuuuaaucu

SEQ ID NO: 3531 - RNA, 23 nt, Homo sapiens
agauuaaaauuuaauauaacuua

SEQ ID NO: 3532 - RNA, 21 nt, Homo sapiens
gcauuuugaagugaugaguga

SEQ ID NO: 3533 - RNA, 23 nt, Homo sapiens
ucacucaucacuucaaaaugcag

SEQ ID NO: 3534 - RNA, 21 nt, Homo sapiens
gaacuaaugagcagacauaac

SEQ ID NO: 3535 - RNA, 23 nt, Homo sapiens
guuaugucugcucauuaguucau

SEQ ID NO: 3536 - RNA, 21 nt, Homo sapiens
aaugaccacaccuaucgaguu

SEQ ID NO: 3537 - RNA, 23 nt, Homo sapiens
aacucgauagguguggucauucu

SEQ ID NO: 3538 - RNA, 21 nt, Homo sapiens
uaaauuuuaaucuauaguaaa

SEQ ID NO: 3539 - RNA, 23 nt, Homo sapiens
uuuacuauagauuaaaauuuaau

SEQ ID NO: 3540 - RNA, 21 nt, Homo sapiens
uucaguaugaucguuucuuug

SEQ ID NO: 3541 - RNA, 23 nt, Homo sapiens
caaagaaacgaucauacugaaaa

SEQ ID NO: 3542 - RNA, 21 nt, Homo sapiens
cacuuuucaguaugaucguuu

SEQ ID NO: 3543 - RNA, 23 nt, Homo sapiens
aaacgaucauacugaaaagugga

SEQ ID NO: 3544 - RNA, 21 nt, Homo sapiens
aaaucuguuuccacuuuucag

SEQ ID NO: 3545 - RNA, 23 nt, Homo sapiens
cugaaaaguggaaacagauuuug

SEQ ID NO: 3546 - RNA, 21 nt, Homo sapiens
cauuugaaacuguccauucaa

SEQ ID NO: 3547 - RNA, 23 nt, Homo sapiens
uugaauggacaguuucaaaugcc

SEQ ID NO: 3548 - RNA, 21 nt, Homo sapiens
ccuaucgaguuuuuaaaacug

SEQ ID NO: 3549 - RNA, 23 nt, Homo sapiens
caguuuuaaaaacucgauaggug

SEQ ID NO: 3550 - RNA, 21 nt, Homo sapiens
gaccagaaagagugucucauc

SEQ ID NO: 3551 - RNA, 23 nt, Homo sapiens
gaugagacacucuuucuggucuu

SEQ ID NO: 3552 - RNA, 21 nt, Homo sapiens
accagaaagagugucucaucu

SEQ ID NO: 3553 - RNA, 23 nt, Homo sapiens
agaugagacacucuuucuggucu

SEQ ID NO: 3554 - RNA, 21 nt, Homo sapiens
acuaaugagcagacauaacau

SEQ ID NO: 3555 - RNA, 23 nt, Homo sapiens
auguuaugucugcucauuaguuc

SEQ ID NO: 3556 - RNA, 21 nt, Homo sapiens
uaguaaaaacauaguccugga

SEQ ID NO: 3557 - RNA, 23 nt, Homo sapiens
uccaggacuauguuuuuacuaua

SEQ ID NO: 3558 - RNA, 21 nt, Homo sapiens
uauuucuggaacuaguaaauu

SEQ ID NO: 3559 - RNA, 23 nt, Homo sapiens
aauuuacuaguuccagaaauauu

SEQ ID NO: 3560 - RNA, 21 nt, Homo sapiens
uucugcaaagccagucuugag

SEQ ID NO: 3561 - RNA, 23 nt, Homo sapiens
cucaagacuggcuuugcagaaga

SEQ ID NO: 3562 - RNA, 21 nt, Homo sapiens
gaggaaagagguugcugaaac

SEQ ID NO: 3563 - RNA, 23 nt, Homo sapiens
guuucagcaaccucuuuccucac

SEQ ID NO: 3564 - RNA, 21 nt, Homo sapiens
gguacuagaaauauuucugga

SEQ ID NO: 3565 - RNA, 23 nt, Homo sapiens
uccagaaauauuucuaguaccac

SEQ ID NO: 3566 - RNA, 21 nt, Homo sapiens
gacaucaugcaaaagcaaaga

SEQ ID NO: 3567 - RNA, 23 nt, Homo sapiens
ucuuugcuuuugcaugauguccu

SEQ ID NO: 3568 - RNA, 21 nt, Homo sapiens
aaauuuuaaucuauaguaaaa

SEQ ID NO: 3569 - RNA, 23 nt, Homo sapiens
uuuuacuauagauuaaaauuuaa

SEQ ID NO: 3570 - RNA, 21 nt, Homo sapiens
caugauccaagggauucgaaa

SEQ ID NO: 3571 - RNA, 23 nt, Homo sapiens
uuucgaaucccuuggaucaugga

SEQ ID NO: 3572 - RNA, 21 nt, Homo sapiens
agaccagaaagagugucucau

SEQ ID NO: 3573 - RNA, 23 nt, Homo sapiens
augagacacucuuucuggucuuu

SEQ ID NO: 3574 - RNA, 21 nt, Homo sapiens
auccugaagagcgcugaggga

SEQ ID NO: 3575 - RNA, 23 nt, Homo sapiens
ucccucagcgcucuucaggaucc

SEQ ID NO: 3576 - RNA, 21 nt, Homo sapiens
gucugugaugaacuaaugagc

SEQ ID NO: 3577 - RNA, 23 nt, Homo sapiens
gcucauuaguucaucacagacuu

SEQ ID NO: 3578 - RNA, 21 nt, Homo sapiens
cagaaagagugucucaucuuc

SEQ ID NO: 3579 - RNA, 23 nt, Homo sapiens
gaagaugagacacucuuucuggu

SEQ ID NO: 3580 - RNA, 21 nt, Homo sapiens
acuuuucaguaugaucguuuc

SEQ ID NO: 3581 - RNA, 23 nt, Homo sapiens
gaaacgaucauacugaaaagugg

SEQ ID NO: 3582 - RNA, 21 nt, Homo sapiens
ucaugccaaaaauggacauca

SEQ ID NO: 3583 - RNA, 23 nt, Homo sapiens
ugauguccauuuuuggcaugacu

SEQ ID NO: 3584 - RNA, 21 nt, Homo sapiens
aauauuucuggaacuaguaaa

SEQ ID NO: 3585 - RNA, 23 nt, Homo sapiens
uuuacuaguuccagaaauauuuc

SEQ ID NO: 3586 - RNA, 21 nt, Homo sapiens
cuucuucaagauaacuugcca

SEQ ID NO: 3587 - RNA, 23 nt, Homo sapiens
uggcaaguuaucuugaagaagau

SEQ ID NO: 3588 - RNA, 21 nt, Homo sapiens
uuucaguaugaucguuucuuu

SEQ ID NO: 3589 - RNA, 23 nt, Homo sapiens
aaagaaacgaucauacugaaaag

SEQ ID NO: 3590 - RNA, 21 nt, Homo sapiens
cccagugugguuagugugaaa

SEQ ID NO: 3591 - RNA, 23 nt, Homo sapiens
uuucacacuaaccacacuggggc

SEQ ID NO: 3592 - RNA, 21 nt, Homo sapiens
gcugugagauuuacucugauu

SEQ ID NO: 3593 - RNA, 23 nt, Homo sapiens
aaucagaguaaaucucacagccu

SEQ ID NO: 3594 - RNA, 21 nt, Homo sapiens
aggcuugagcaaguugguauc

SEQ ID NO: 3595 - RNA, 23 nt, Homo sapiens
gauaccaacuugcucaagccuga

SEQ ID NO: 3596 - RNA, 21 nt, Homo sapiens
gaaagagugucucaucuucuu

SEQ ID NO: 3597 - RNA, 23 nt, Homo sapiens
aagaagaugagacacucuuucug

SEQ ID NO: 3598 - RNA, 21 nt, Homo sapiens
auuucuggaacuaguaaauuc

SEQ ID NO: 3599 - RNA, 23 nt, Homo sapiens
gaauuuacuaguuccagaaauau

SEQ ID NO: 3600 - RNA, 21 nt, Homo sapiens
ugugauguggcccaugaguuu

SEQ ID NO: 3601 - RNA, 23 nt, Homo sapiens
aaacucaugggccacaucacaca

SEQ ID NO: 3602 - RNA, 21 nt, Homo sapiens
aagagagaaguccuauuucuc

SEQ ID NO: 3603 - RNA, 23 nt, Homo sapiens
gagaaauaggacuucucucuuuc

SEQ ID NO: 3604 - RNA, 21 nt, Homo sapiens
uggcagcacagaugaaucaga

SEQ ID NO: 3605 - RNA, 23 nt, Homo sapiens
ucugauucaucugugcugccagg

SEQ ID NO: 3606 - RNA, 21 nt, Homo sapiens
augaucguuucuuugagaaaa

SEQ ID NO: 3607 - RNA, 23 nt, Homo sapiens
uuuucucaaagaaacgaucauac

SEQ ID NO: 3608 - RNA, 21 nt, Homo sapiens
ucuggaacuaguaaauuccau

SEQ ID NO: 3609 - RNA, 23 nt, Homo sapiens
auggaauuuacuaguuccagaaa

SEQ ID NO: 3610 - RNA, 19 nt, Homo sapiens
gcccauucuuaucccgagu

SEQ ID NO: 3611 - RNA, 19 nt, Homo sapiens
acucgggauaagaaugggc

SEQ ID NO: 3612 - RNA, 19 nt, Homo sapiens
ggaaccaugccuccaugau

SEQ ID NO: 3613 - RNA, 19 nt, Homo sapiens
aucauggaggcaugguucc

SEQ ID NO: 3614 - RNA, 19 nt, Homo sapiens
uggagucugugcggauccu

SEQ ID NO: 3615 - RNA, 19 nt, Homo sapiens
aggauccgcacagacucca

SEQ ID NO: 3616 - RNA, 19 nt, Homo sapiens
cacccacggguguguggga

SEQ ID NO: 3617 - RNA, 19 nt, Homo sapiens
ucccacacacccgugggug

SEQ ID NO: 3618 - RNA, 19 nt, Homo sapiens
ggagucugugcggauccua

SEQ ID NO: 3619 - RNA, 19 nt, Homo sapiens
uaggauccgcacagacucc

SEQ ID NO: 3620 - RNA, 19 nt, Homo sapiens
caaaacugccccaagauga

SEQ ID NO: 3621 - RNA, 19 nt, Homo sapiens
ucaucuuggggcaguuuug

SEQ ID NO: 3622 - RNA, 19 nt, Homo sapiens
gccuccaugauccaaggga

SEQ ID NO: 3623 - RNA, 19 nt, Homo sapiens
ucccuuggaucauggaggc

SEQ ID NO: 3624 - RNA, 19 nt, Homo sapiens
caucaucccugugcggguu

SEQ ID NO: 3625 - RNA, 19 nt, Homo sapiens
aacccgcacagggaugaug

SEQ ID NO: 3626 - RNA, 19 nt, Homo sapiens
acccacgggugugugggga

SEQ ID NO: 3627 - RNA, 19 nt, Homo sapiens
uccccacacacccgugggu

SEQ ID NO: 3628 - RNA, 19 nt, Homo sapiens
cacaucaucccugugcgga

SEQ ID NO: 3629 - RNA, 19 nt, Homo sapiens
uccgcacagggaugaugug

SEQ ID NO: 3630 - RNA, 19 nt, Homo sapiens
cagaaagagugucucaucu

SEQ ID NO: 3631 - RNA, 19 nt, Homo sapiens
agaugagacacucuuucug

SEQ ID NO: 3632 - RNA, 19 nt, Homo sapiens
ccuccaugauccaagggau

SEQ ID NO: 3633 - RNA, 19 nt, Homo sapiens
aucccuuggaucauggagg

SEQ ID NO: 3634 - RNA, 19 nt, Homo sapiens
ugcccauucuuaucccgaa

SEQ ID NO: 3635 - RNA, 19 nt, Homo sapiens
uucgggauaagaaugggca

SEQ ID NO: 3636 - RNA, 19 nt, Homo sapiens
cuucacccuggcuaagaua

SEQ ID NO: 3637 - RNA, 19 nt, Homo sapiens
uaucuuagccagggugaag

SEQ ID NO: 3638 - RNA, 19 nt, Homo sapiens
aucaucccugugcggguua

SEQ ID NO: 3639 - RNA, 19 nt, Homo sapiens
uaacccgcacagggaugau

SEQ ID NO: 3640 - RNA, 19 nt, Homo sapiens
agaaagagugucucaucuu

SEQ ID NO: 3641 - RNA, 19 nt, Homo sapiens
aagaugagacacucuuucu

SEQ ID NO: 3642 - RNA, 19 nt, Homo sapiens
cuccaugauccaagggauu

SEQ ID NO: 3643 - RNA, 19 nt, Homo sapiens
aaucccuuggaucauggag

SEQ ID NO: 3644 - RNA, 19 nt, Homo sapiens
ccauucuuaucccgaguca

SEQ ID NO: 3645 - RNA, 19 nt, Homo sapiens
ugacucgggauaagaaugg

SEQ ID NO: 3646 - RNA, 19 nt, Homo sapiens
cacccuggcuaagaugaua

SEQ ID NO: 3647 - RNA, 19 nt, Homo sapiens
uaucaucuuagccagggug

SEQ ID NO: 3648 - RNA, 19 nt, Homo sapiens
ucaucccugugcggguuga

SEQ ID NO: 3649 - RNA, 19 nt, Homo sapiens
ucaacccgcacagggauga

SEQ ID NO: 3650 - RNA, 19 nt, Homo sapiens
aagagugucucaucuucuu

SEQ ID NO: 3651 - RNA, 19 nt, Homo sapiens
aagaagaugagacacucuu

SEQ ID NO: 3652 - RNA, 19 nt, Homo sapiens
gucaugccaaaaauggaca

SEQ ID NO: 3653 - RNA, 19 nt, Homo sapiens
uguccauuuuuggcaugac

SEQ ID NO: 3654 - RNA, 19 nt, Homo sapiens
cauucuuaucccgagucca

SEQ ID NO: 3655 - RNA, 19 nt, Homo sapiens
uggacucgggauaagaaug

SEQ ID NO: 3656 - RNA, 19 nt, Homo sapiens
acccuggcuaagaugauga

SEQ ID NO: 3657 - RNA, 19 nt, Homo sapiens
ucaucaucuuagccagggu

SEQ ID NO: 3658 - RNA, 19 nt, Homo sapiens
cucuucacccuggcuaaga

SEQ ID NO: 3659 - RNA, 19 nt, Homo sapiens
ucuuagccagggugaagag

SEQ ID NO: 3660 - RNA, 19 nt, Homo sapiens
augccaaaaauggacauca

SEQ ID NO: 3661 - RNA, 19 nt, Homo sapiens
ugauguccauuuuuggcau

SEQ ID NO: 3662 - RNA, 19 nt, Homo sapiens
ugccccaagaugauggaau

SEQ ID NO: 3663 - RNA, 19 nt, Homo sapiens
auuccaucaucuuggggca

SEQ ID NO: 3664 - RNA, 19 nt, Homo sapiens
gaaccaugccuccaugaua

SEQ ID NO: 3665 - RNA, 19 nt, Homo sapiens
uaucauggaggcaugguuc

SEQ ID NO: 3666 - RNA, 19 nt, Homo sapiens
ucuucacccuggcuaagau

SEQ ID NO: 3667 - RNA, 19 nt, Homo sapiens
aucuuagccagggugaaga

SEQ ID NO: 3668 - RNA, 19 nt, Homo sapiens
ugccaaaaauggacaucau

SEQ ID NO: 3669 - RNA, 19 nt, Homo sapiens
augauguccauuuuuggca

SEQ ID NO: 3670 - RNA, 19 nt, Homo sapiens
ccagaaagagugucucaua

SEQ ID NO: 3671 - RNA, 19 nt, Homo sapiens
uaugagacacucuuucugg

SEQ ID NO: 3672 - RNA, 19 nt, Homo sapiens
gaaacuguccauucaauga

SEQ ID NO: 3673 - RNA, 19 nt, Homo sapiens
ucauugaauggacaguuuc

SEQ ID NO: 3674 - RNA, 19 nt, Homo sapiens
ucacccuggcuaagaugau

SEQ ID NO: 3675 - RNA, 19 nt, Homo sapiens
aucaucuuagccaggguga

SEQ ID NO: 3676 - RNA, 19 nt, Homo sapiens
cccuggagucugugcggau

SEQ ID NO: 3677 - RNA, 19 nt, Homo sapiens
auccgcacagacuccaggg

SEQ ID NO: 3678 - RNA, 19 nt, Homo sapiens
gaaagagugucucaucuua

SEQ ID NO: 3679 - RNA, 19 nt, Homo sapiens
uaagaugagacacucuuuc

SEQ ID NO: 3680 - RNA, 19 nt, Homo sapiens
uggagcccuggagucugua

SEQ ID NO: 3681 - RNA, 19 nt, Homo sapiens
uacagacuccagggcucca

SEQ ID NO: 3682 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuacgcugaguacuucgatt

SEQ ID NO: 3683 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgaaguacucagcguaagtt

SEQ ID NO: 3684 - RNA, 21 nt, Homo sapiens
caugccaaaaauggacaucau

SEQ ID NO: 3685 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caggcaaaucucuguuguutt

SEQ ID NO: 3686 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacaacagagauuugccugtt

SEQ ID NO: 3687 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaaaaaauugaugagaaatt

SEQ ID NO: 3688 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuucucaucaauuuuuuuctt

SEQ ID NO: 3689 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaaagaugccgcacucuutt

SEQ ID NO: 3690 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagagugcggcaucuuucctt

SEQ ID NO: 3691 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucucaucuucuucaagatt

SEQ ID NO: 3692 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuugaagaagaugagacatt

SEQ ID NO: 3693 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaucuacgugcaagcaautt

SEQ ID NO: 3694 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auugcuugcacguagaugutt

SEQ ID NO: 3695 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucucugauugacaccguatt

SEQ ID NO: 3696 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacggugucaaucagagaatt

SEQ ID NO: 3697 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcugcuggcuucaucuucatt

SEQ ID NO: 3698 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaagaugaagccagcagctt

SEQ ID NO: 3699 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcgcaacgucaaacucautt

SEQ ID NO: 3700 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augaguuugacguugcgcutt

SEQ ID NO: 3701 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauuucuggaacuaguaaatt

SEQ ID NO: 3702 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuacuaguuccagaaauatt

SEQ ID NO: 3703 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gguuguguuggaggguacatt

SEQ ID NO: 3704 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguacccuccaacacaacctt

SEQ ID NO: 3705 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugucagucuggugcaguatt

SEQ ID NO: 3706 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacugcaccagacugacactt

SEQ ID NO: 3707 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuuguggccaaugacucatt

SEQ ID NO: 3708 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugagucauuggccacaaagtt

SEQ ID NO: 3709 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaugcugcuaaaaacacatt

SEQ ID NO: 3710 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguguuuuuagcagcaucutt

SEQ ID NO: 3711 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagucaugccaaaaauggatt

SEQ ID NO: 3712 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccauuuuuggcaugacuctt

SEQ ID NO: 3713 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugugcggauccugaagagtt

SEQ ID NO: 3714 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucuucaggauccgcacagtt

SEQ ID NO: 3715 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacuuugaaacaacauggutt

SEQ ID NO: 3716 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accauguuguuucaaagugtt

SEQ ID NO: 3717 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagugaugagugaaagagatt

SEQ ID NO: 3718 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucuuucacucaucacuutt

SEQ ID NO: 3719 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucugcuagucacauggaatt

SEQ ID NO: 3720 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccaugugacuagcagautt

SEQ ID NO: 3721 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggggcaggugguacuagatt

SEQ ID NO: 3722 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuaguaccaccugccccatt

SEQ ID NO: 3723 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcagaugacuauucagacutt

SEQ ID NO: 3724 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agucugaauagucaucugctt

SEQ ID NO: 3725 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccucauuccucagcugagtt

SEQ ID NO: 3726 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucagcugaggaaugaggctt

SEQ ID NO: 3727 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guaugaucguuucuuugagtt

SEQ ID NO: 3728 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucaaagaaacgaucauactt

SEQ ID NO: 3729 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauccagauggucuucagatt

SEQ ID NO: 3730 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugaagaccaucuggauatt

SEQ ID NO: 3731 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagugugaaaaccgauggatt

SEQ ID NO: 3732 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccaucgguuuucacacuatt

SEQ ID NO: 3733 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccccauggcagaugacuatt

SEQ ID NO: 3734 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagucaucugccauggggatt

SEQ ID NO: 3735 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccacugcagcaguacacuatt

SEQ ID NO: 3736 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaguguacugcugcaguggtt

SEQ ID NO: 3737 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugugaaccggcgagcacatt

SEQ ID NO: 3738 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugugcucgccgguucacagtt

SEQ ID NO: 3739 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gguccuaugcugcuggcuutt

SEQ ID NO: 3740 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagccagcagcauaggacctt

SEQ ID NO: 3741 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agccuuugguuguguuggatt

SEQ ID NO: 3742 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccaacacaaccaaaggcutt

SEQ ID NO: 3743 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauuccauguggacuuagatt

SEQ ID NO: 3744 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuaaguccacauggaauutt

SEQ ID NO: 3745 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccagggcacugcaagcaaatt

SEQ ID NO: 3746 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuugcuugcagugcccuggtt

SEQ ID NO: 3747 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuuucaguaugaucguuutt

SEQ ID NO: 3748 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaacgaucauacugaaaagtt

SEQ ID NO: 3749 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaucagagaggcagcagutt

SEQ ID NO: 3750 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acugcugccucucugauuctt

SEQ ID NO: 3751 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcaaagaucugaccccucatt

SEQ ID NO: 3752 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaggggucagaucuuugctt

SEQ ID NO: 3753 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggagaagagcuccuacggatt

SEQ ID NO: 3754 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccguaggagcucuucucctt

SEQ ID NO: 3755 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaugaguuuggagcaauctt

SEQ ID NO: 3756 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauugcuccaaacucauggtt

SEQ ID NO: 3757 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuugagaaaaaaauugautt

SEQ ID NO: 3758 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucaauuuuuuucucaaagtt

SEQ ID NO: 3759 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugagcagacauaacaucuatt

SEQ ID NO: 3760 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagauguuaugucugcucatt

SEQ ID NO: 3761 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgugcaagcaaucaauuactt

SEQ ID NO: 3762 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guaauugauugcuugcacgtt

SEQ ID NO: 3763 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaagcaaagaccagaaagatt

SEQ ID NO: 3764 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuuucuggucuuugcuuutt

SEQ ID NO: 3765 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaugugcaggaaaugaautt

SEQ ID NO: 3766 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auucauuuccugcacaucctt

SEQ ID NO: 3767 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagcauacuuccugaacautt

SEQ ID NO: 3768 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auguucaggaaguaugcugtt

SEQ ID NO: 3769 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcagcacagaugaaucagatt

SEQ ID NO: 3770 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugauucaucugugcugctt

SEQ ID NO: 3771 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuguuguucuaugcccaatt

SEQ ID NO: 3772 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugggcauagaacaacagatt

SEQ ID NO: 3773 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugagacagaugcuaauggatt

SEQ ID NO: 3774 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccauuagcaucugucucatt

SEQ ID NO: 3775 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccaaugacucaacccucutt

SEQ ID NO: 3776 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaggguugagucauuggctt

SEQ ID NO: 3777 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagugcaacuucugcaggatt

SEQ ID NO: 3778 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccugcagaaguugcacuctt

SEQ ID NO: 3779 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugaaagagagaaguccuatt

SEQ ID NO: 3780 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaggacuucucucuuucactt

SEQ ID NO: 3781 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaacuugccaaaaucuguutt

SEQ ID NO: 3782 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacagauuuuggcaaguuatt

SEQ ID NO: 3783 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagccagucuugagcuucatt

SEQ ID NO: 3784 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaagcucaagacuggcuutt

SEQ ID NO: 3785 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacuuuucaguaugaucgutt

SEQ ID NO: 3786 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acgaucauacugaaaagugtt

SEQ ID NO: 3787 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcagcagugucuucugcaatt

SEQ ID NO: 3788 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugcagaagacacugcugctt

SEQ ID NO: 3789 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccugaacauggagagugutt

SEQ ID NO: 3790 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acacucuccauguucaggatt

SEQ ID NO: 3791 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuucuggaacacuuggcatt

SEQ ID NO: 3792 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccaaguguuccagaaautt

SEQ ID NO: 3793 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caguacacuaccaacagautt

SEQ ID NO: 3794 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucuguugguaguguacugtt

SEQ ID NO: 3795 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcaugaccucaauuauuuctt

SEQ ID NO: 3796 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaauaauugaggucaugctt

SEQ ID NO: 3797 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaacugcugcaaagaucutt

SEQ ID NO: 3798 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaucuuugcagcaguucutt

SEQ ID NO: 3799 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caccccagaugaugaacuatt

SEQ ID NO: 3800 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaguucaucaucuggggugtt

SEQ ID NO: 3801 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauccaagggauucgaaactt

SEQ ID NO: 3802 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guuucgaaucccuuggauctt

SEQ ID NO: 3803 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucaucaccaaaaagcaagtt

SEQ ID NO: 3804 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuugcuuuuuggugaugagtt

SEQ ID NO: 3805 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaacauggugcuggggcatt

SEQ ID NO: 3806 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccccagcaccauguugutt

SEQ ID NO: 3807 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaucguuucuuugagaaaatt

SEQ ID NO: 3808 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuucucaaagaaacgauctt

SEQ ID NO: 3809 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagcacgaguucucugauutt

SEQ ID NO: 3810 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaucagagaacucgugcugtt

SEQ ID NO: 3811 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaugaugucagccaccucatt

SEQ ID NO: 3812 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugagguggcugacaucauutt

SEQ ID NO: 3813 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguuauggacacuuugaaatt

SEQ ID NO: 3814 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuucaaaguguccauaacutt

SEQ ID NO: 3815 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaugaugaacuacuuccuutt

SEQ ID NO: 3816 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaggaaguaguucaucauctt

SEQ ID NO: 3817 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcaggaaaugaaugccgugtt

SEQ ID NO: 3818 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacggcauucauuuccugctt

SEQ ID NO: 3819 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuucaagauaacuugccatt

SEQ ID NO: 3820 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggcaaguuaucuugaagatt

SEQ ID NO: 3821 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgauggaggggaucccagutt

SEQ ID NO: 3822 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acugggauccccuccaucgtt

SEQ ID NO: 3823 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaaaaagcaagugucagutt

SEQ ID NO: 3824 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acugacacuugcuuuuuggtt

SEQ ID NO: 3825 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauuggggaucgggauggatt

SEQ ID NO: 3826 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccaucccgauccccaauctt

SEQ ID NO: 3827 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccuggagucugugcggautt

SEQ ID NO: 3828 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auccgcacagacuccagggtt

SEQ ID NO: 3829 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guugucuuuauaugugaautt

SEQ ID NO: 3830 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auucacauauaaagacaactt

SEQ ID NO: 3831 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgggcauuguccacugcagtt

SEQ ID NO: 3832 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcaguggacaaugcccgtt

SEQ ID NO: 3833 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauucagacucccucaucatt

SEQ ID NO: 3834 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaugagggagucugaauatt

SEQ ID NO: 3835 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacugcauuuugaagugautt

SEQ ID NO: 3836 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucacuucaaaaugcagugtt

SEQ ID NO: 3837 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccagaaagagugucucauctt

SEQ ID NO: 3838 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaugagacacucuuucuggtt

SEQ ID NO: 3839 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggcggagggauuggggautt

SEQ ID NO: 3840 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auccccaaucccuccgccutt

SEQ ID NO: 3841 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaccuccaugggaaagautt

SEQ ID NO: 3842 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucuuucccauggaggucutt

SEQ ID NO: 3843 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcaggaggccacugcauuutt

SEQ ID NO: 3844 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaugcaguggccuccugctt

SEQ ID NO: 3845 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucuguuuccacuuuucagtt

SEQ ID NO: 3846 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugaaaaguggaaacagautt

SEQ ID NO: 3847 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agagaaguccuauuucucatt

SEQ ID NO: 3848 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugagaaauaggacuucucutt

SEQ ID NO: 3849 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucuucagaguugucuuuatt

SEQ ID NO: 3850 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaaagacaacucugaagactt

SEQ ID NO: 3851 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcuggaacugaagccucatt

SEQ ID NO: 3852 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaggcuucaguuccagcctt

SEQ ID NO: 3853 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccauuaucauauccagautt

SEQ ID NO: 3854 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucuggauaugauaauggctt

SEQ ID NO: 3855 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcaggccccagugugguutt

SEQ ID NO: 3856 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaccacacuggggccugcutt

SEQ ID NO: 3857 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagcugagugcaacuucutt

SEQ ID NO: 3858 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaaguugcacucagcugatt

SEQ ID NO: 3859 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagcacacaucuuccccautt

SEQ ID NO: 3860 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auggggaagaugugugcuctt

SEQ ID NO: 3861 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuuccaggacaucaugcatt

SEQ ID NO: 3862 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcaugauguccuggaagutt

SEQ ID NO: 3863 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuaucgaguuuuuaaaactt

SEQ ID NO: 3864 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guuuuaaaaacucgauaggtt

SEQ ID NO: 3865 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuccuugagaaucugcuatt

SEQ ID NO: 3866 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagcagauucucaaggaagtt

SEQ ID NO: 3867 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accaacagaucaaagaaactt

SEQ ID NO: 3868 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guuucuuugaucuguuggutt

SEQ ID NO: 3869 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaaccccaggccauuaucatt

SEQ ID NO: 3870 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugauaauggccugggguuatt

SEQ ID NO: 3871 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaugccuccaugauccaatt

SEQ ID NO: 3872 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuggaucauggaggcauggtt

SEQ ID NO: 3873 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaugaacuaaugagcagatt

SEQ ID NO: 3874 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugcucauuaguucaucatt

SEQ ID NO: 3875 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccugaagagcgcugagggatt

SEQ ID NO: 3876 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucccucagcgcucuucaggtt

SEQ ID NO: 3877 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacacuuggcaaagccuuutt

SEQ ID NO: 3878 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaggcuuugccaaguguutt

SEQ ID NO: 3879 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugcagaaagcaggcaaatt

SEQ ID NO: 3880 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuugccugcuuucugcagatt

SEQ ID NO: 3881 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccggccucccuguuguccatt

SEQ ID NO: 3882 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggacaacagggaggccggtt

SEQ ID NO: 3883 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caucaucccugugcggguutt

SEQ ID NO: 3884 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacccgcacagggaugaugtt

SEQ ID NO: 3885 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugugcggguugcagaugcutt

SEQ ID NO: 3886 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcaucugcaacccgcacatt

SEQ ID NO: 3887 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaaagagguugcugaaactt

SEQ ID NO: 3888 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guuucagcaaccucuuucctt

SEQ ID NO: 3889 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agguccacgcaguggggcutt

SEQ ID NO: 3890 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agccccacugcguggaccutt

SEQ ID NO: 3891 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccgugaggaaagagguutt

SEQ ID NO: 3892 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaccucuuuccucacggcatt

SEQ ID NO: 3893 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcuaauggaugccggccuctt

SEQ ID NO: 3894 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaggccggcauccauuagctt

SEQ ID NO: 3895 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaagcaaguggggcuggaatt

SEQ ID NO: 3896 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccagccccacuugcuuctt

SEQ ID NO: 3897 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caucuuccgccacaaugautt

SEQ ID NO: 3898 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucauuguggcggaagaugtt

SEQ ID NO: 3899 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuucucaggcuugagcaatt

SEQ ID NO: 3900 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugcucaagccugagaaautt

SEQ ID NO: 3901 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccgagucccccaggccuutt

SEQ ID NO: 3902 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaggccugggggacucgggtt

SEQ ID NO: 3903 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caagcaaaugcccuuuccutt

SEQ ID NO: 3904 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggaaagggcauuugcuugtt

SEQ ID NO: 3905 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccccucaguccccaagauutt

SEQ ID NO: 3906 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaucuuggggacugaggggtt

SEQ ID NO: 3907 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuacggugccccggggagatt

SEQ ID NO: 3908 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuccccggggcaccguagtt

SEQ ID NO: 3909 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaacugccccaagaugautt

SEQ ID NO: 3910 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucaucuuggggcaguuuutt

SEQ ID NO: 3911 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaaaacugcuaaggccaatt

SEQ ID NO: 3912 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuggccuuagcaguuuugutt

SEQ ID NO: 3913 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauucugggaaccaugccutt

SEQ ID NO: 3914 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggcaugguucccagaauctt

SEQ ID NO: 3915 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccagauggcacacagcuuctt

SEQ ID NO: 3916 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaagcugugugccaucuggtt

SEQ ID NO: 3917 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agggauucgaaacagccgatt

SEQ ID NO: 3918 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucggcuguuucgaaucccutt

SEQ ID NO: 3919 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucugcaguccucagcgcatt

SEQ ID NO: 3920 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcgcugaggacugcagagtt

SEQ ID NO: 3921 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccgccgccucugcaguccutt

SEQ ID NO: 3922 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggacugcagaggcggcggtt

SEQ ID NO: 3923 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuggcuggagcccuggagutt

SEQ ID NO: 3924 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuccagggcuccagccagtt

SEQ ID NO: 3925 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacaucaugcaaaagcaaatt

SEQ ID NO: 3926 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuugcuuuugcaugauguctt

SEQ ID NO: 3927 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcuugagcaaguugguauctt

SEQ ID NO: 3928 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauaccaacuugcucaagctt

SEQ ID NO: 3929 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caggcugugagauuuacuctt

SEQ ID NO: 3930 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaguaaaucucacagccugtt

SEQ ID NO: 3931 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agagcugugugauguggcctt

SEQ ID NO: 3932 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggccacaucacacagcucutt

SEQ ID NO: 3933 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggagcuggcagaccuccautt

SEQ ID NO: 3934 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auggaggucugccagcucctt

SEQ ID NO: 3935 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucccaguggacugcugaatt

SEQ ID NO: 3936 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucagcaguccacugggautt

SEQ ID NO: 3937 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gucaaacucaugagacagatt

SEQ ID NO: 3938 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugucucaugaguuugactt

SEQ ID NO: 3939 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuuccuggcagcacagautt

SEQ ID NO: 3940 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucugugcugccaggaaagtt

SEQ ID NO: 3941 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccuccggccagugagaaatt

SEQ ID NO: 3942 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuucucacuggccggagggtt

SEQ ID NO: 3943 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuaccuaggaaugagucgctt

SEQ ID NO: 3944 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcgacucauuccuagguagtt

SEQ ID NO: 3945 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccaagauuguggcauuugtt

SEQ ID NO: 3946 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caaaugccacaaucuugggtt

SEQ ID NO: 3947 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagcaaucaccuucguggatt

SEQ ID NO: 3948 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccacgaaggugauugcuctt

SEQ ID NO: 3949 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcccauucuuaucccgagtt

SEQ ID NO: 3950 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucgggauaagaaugggcatt

SEQ ID NO: 3951 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaggccaagguccaacagatt

SEQ ID NO: 3952 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuguuggaccuuggccuutt

SEQ ID NO: 3953 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cacacagcuuccgucuggatt

SEQ ID NO: 3954 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccagacggaagcugugugtt

SEQ ID NO: 3955 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuauggggcucgaggcggatt

SEQ ID NO: 3956 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccgccucgagccccauaatt

SEQ ID NO: 3957 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucuucugcaaagccagutt

SEQ ID NO: 3958 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuggcuuugcagaagacatt

SEQ ID NO: 3959 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggccugagcaugaccucatt

SEQ ID NO: 3960 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaggucaugcucaggccutt

SEQ ID NO: 3961 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augugaauuaaguuauauutt

SEQ ID NO: 3962 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauauaacuuaauucacautt

SEQ ID NO: 3963 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acugcugaagaacuuccagtt

SEQ ID NO: 3964 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuggaaguucuucagcagutt

SEQ ID NO: 3965 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugagaaagacaaaacugcutt

SEQ ID NO: 3966 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcaguuuugucuuucucatt

SEQ ID NO: 3967 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagccaccucagagaacutt

SEQ ID NO: 3968 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguucucugagguggcugatt

SEQ ID NO: 3969 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcaacgagcguuucguuutt

SEQ ID NO: 3970 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaacgaaacgcucguugcctt

SEQ ID NO: 3971 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccugauggaucccagcagatt

SEQ ID NO: 3972 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugcugggauccaucaggtt

SEQ ID NO: 3973 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugugcccacuggaagagcutt

SEQ ID NO: 3974 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcucuuccagugggcacatt

SEQ ID NO: 3975 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccacaggagccagcauacutt

SEQ ID NO: 3976 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguaugcuggcuccuguggtt

SEQ ID NO: 3977 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugguacuagaaauauuuctt

SEQ ID NO: 3978 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaauauuucuaguaccactt

SEQ ID NO: 3979 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucgccgcugcccauucuutt

SEQ ID NO: 3980 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagaaugggcagcggcgaatt

SEQ ID NO: 3981 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccgccagcaccagcgcaactt

SEQ ID NO: 3982 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guugcgcuggugcuggcggtt

SEQ ID NO: 3983 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgcugagggacgggugcuutt

SEQ ID NO: 3984 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagcacccgucccucagcgtt

SEQ ID NO: 3985 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggacuucucgacuugagutt

SEQ ID NO: 3986 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucaagucgagaaguccatt

SEQ ID NO: 3987 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaagaaaccccuccggccatt

SEQ ID NO: 3988 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggccggagggguuucuuutt

SEQ ID NO: 3989 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugacaccguacgguccuatt

SEQ ID NO: 3990 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaggaccguacggugucaatt

SEQ ID NO: 3991 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccucuucacccuggcuaatt

SEQ ID NO: 3992 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuagccagggugaagagggtt

SEQ ID NO: 3993 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccccaggccuuucugcagtt

SEQ ID NO: 3994 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcagaaaggccugggggtt

SEQ ID NO: 3995 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augcccaaaacugccccaatt

SEQ ID NO: 3996 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuggggcaguuuugggcautt

SEQ ID NO: 3997 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuugagugcccgccuccuutt

SEQ ID NO: 3998 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaggaggcgggcacucaagtt

SEQ ID NO: 3999 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggguacaucgccagcacgatt

SEQ ID NO: 4000 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgugcuggcgauguaccctt

SEQ ID NO: 4001 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guguggggcaguuauggactt

SEQ ID NO: 4002 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guccauaacugccccacactt

SEQ ID NO: 4003 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acauaguccuggaaauaaatt

SEQ ID NO: 4004 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuauuuccaggacuaugutt

SEQ ID NO: 4005 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucccagcagaguccagautt

SEQ ID NO: 4006 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucuggacucugcugggautt

SEQ ID NO: 4007 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuagauucuuuccacaggatt

SEQ ID NO: 4008 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccuguggaaagaaucuagtt

SEQ ID NO: 4009 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuguuuuccucgugcuuugtt

SEQ ID NO: 4010 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caaagcacgaggaaaacaatt

SEQ ID NO: 4011 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuccuucgccgccgccuctt

SEQ ID NO: 4012 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaggcggcggcgaaggaggtt

SEQ ID NO: 4013 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaggcugcucccggacaatt

SEQ ID NO: 4014 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuguccgggagcagccucatt

SEQ ID NO: 4015 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaacagacuccugauggatt

SEQ ID NO: 4016 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccaucaggagucuguuggtt

SEQ ID NO: 4017 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucacauggaagcaagugggtt

SEQ ID NO: 4018 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccacuugcuuccaugugatt

SEQ ID NO: 4019 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauucaauggauggggcggtt

SEQ ID NO: 4020 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccgccccauccauugaaugtt

SEQ ID NO: 4021 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggaaugagucgccacccatt

SEQ ID NO: 4022 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggguggcgacucauuccutt

SEQ ID NO: 4023 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggacuuagagcgggagcutt

SEQ ID NO: 4024 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcucccgcucuaaguccatt

SEQ ID NO: 4025 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuaaaaacacagaagucugtt

SEQ ID NO: 4026 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagacuucuguguuuuuagtt

SEQ ID NO: 4027 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccucaccacacaccccagtt

SEQ ID NO: 4028 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugggguguguggugagggtt

SEQ ID NO: 4029 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauccuugcuucagggacutt

SEQ ID NO: 4030 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agucccugaagcaaggauutt

SEQ ID NO: 4031 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuguggcauuugaaacugutt

SEQ ID NO: 4032 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaguuucaaaugccacaatt

SEQ ID NO: 4033 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaauuacccuacggugcctt

SEQ ID NO: 4034 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcaccguaggguaauugatt

SEQ ID NO: 4035 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caagccagccccucgggcatt

SEQ ID NO: 4036 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcccgaggggcuggcuugtt

SEQ ID NO: 4037 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagucuucccugccuggautt

SEQ ID NO: 4038 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auccaggcagggaagacuctt

SEQ ID NO: 4039 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggagaguguuguucgccgtt

SEQ ID NO: 4040 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cggcgaacaacacucuccatt

SEQ ID NO: 4041 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accccuugccugccacaagtt

SEQ ID NO: 4042 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuguggcaggcaaggggutt

SEQ ID NO: 4043 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuggauggaugaguggcuutt

SEQ ID NO: 4044 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagccacucauccauccagtt

SEQ ID NO: 4045 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caagaugauggaaguugggtt

SEQ ID NO: 4046 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccaacuuccaucaucuugtt

SEQ ID NO: 4047 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuucguuuggacuucucgatt

SEQ ID NO: 4048 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgagaaguccaaacgaaatt

SEQ ID NO: 4049 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaucuucaccaccucucutt

SEQ ID NO: 4050 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agagagguggugaagaugatt

SEQ ID NO: 4051 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcccaguucuucccgcugtt

SEQ ID NO: 4052 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagcgggaagaacugggcatt

SEQ ID NO: 4053 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaaauggacaucauuucutt

SEQ ID NO: 4054 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaaaugauguccauuuuutt

SEQ ID NO: 4055 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuugagcuucaggaggaugtt

SEQ ID NO: 4056 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauccuccugaagcucaagtt

SEQ ID NO: 4057 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccucucugccacccaugcutt

SEQ ID NO: 4058 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcauggguggcagagaggtt

SEQ ID NO: 4059 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaagucaggaucccuaagatt

SEQ ID NO: 4060 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuuagggauccugacuuutt

SEQ ID NO: 4061 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgaccacggaggaauccuutt

SEQ ID NO: 4062 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaggauuccuccguggucgtt

SEQ ID NO: 4063 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccgucuggacaccccuutt

SEQ ID NO: 4064 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagggguguccagacggaatt

SEQ ID NO: 4065 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccacccaugcugcuggcugtt

SEQ ID NO: 4066 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagccagcagcauggguggtt

SEQ ID NO: 4067 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugagaaaaagaaugaccactt

SEQ ID NO: 4068 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guggucauucuuuuucucatt

SEQ ID NO: 4069 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaagaugaugccaggcugutt

SEQ ID NO: 4070 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acagccuggcaucaucuuatt

SEQ ID NO: 4071 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguuauauuaaauuuuaautt

SEQ ID NO: 4072 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuaaaauuuaauauaacutt

SEQ ID NO: 4073 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuucccgcuguggggacatt

SEQ ID NO: 4074 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguccccacagcgggaagatt

SEQ ID NO: 4075 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccacaagccagggcacutt

SEQ ID NO: 4076 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agugcccuggcuuguggcatt

SEQ ID NO: 4077 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcgcaguuaugcccaguutt

SEQ ID NO: 4078 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacugggcauaacugcgcutt

SEQ ID NO: 4079 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaccaggagaaagucaggtt

SEQ ID NO: 4080 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccugacuuucuccuggucctt

SEQ ID NO: 4081 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguccacugccccagccactt

SEQ ID NO: 4082 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guggcuggggcaguggacatt

SEQ ID NO: 4083 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucgcggccugaggcugcutt

SEQ ID NO: 4084 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcagccucaggccgcgautt

SEQ ID NO: 4085 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggggauguggggaccaggatt

SEQ ID NO: 4086 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccugguccccacaucccctt

SEQ ID NO: 4087 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuggaaauaaauucuugcutt

SEQ ID NO: 4088 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcaagaauuuauuuccagtt

SEQ ID NO: 4089 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugaaacuguccauucaautt

SEQ ID NO: 4090 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auugaauggacaguuucaatt

SEQ ID NO: 4091 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guggggacacgaccacggatt

SEQ ID NO: 4092 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccguggucguguccccactt

SEQ ID NO: 4093 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgcaguggggcuuuaugggtt

SEQ ID NO: 4094 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccauaaagccccacugcgtt

SEQ ID NO: 4095 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugucuuuauaugugaauutt

SEQ ID NO: 4096 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauucacauauaaagacaatt

SEQ ID NO: 4097 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucacccuggcuaagaugautt

SEQ ID NO: 4098 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucaucuuagccagggugatt

SEQ ID NO: 4099 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guaucugcucaggccugagtt

SEQ ID NO: 4100 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucaggccugagcagauactt

SEQ ID NO: 4101 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augaguggcuucuucuccatt

SEQ ID NO: 4102 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggagaagaagccacucautt

SEQ ID NO: 4103 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaguuggggccaagccagtt

SEQ ID NO: 4104 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuggcuuggccccaacuuctt

SEQ ID NO: 4105 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagggacucgggacccugtt

SEQ ID NO: 4106 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagggucccgagucccugatt

SEQ ID NO: 4107 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccuacggauugcccccactt

SEQ ID NO: 4108 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugggggcaauccguaggatt

SEQ ID NO: 4109 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuacucugauucugggaactt

SEQ ID NO: 4110 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guucccagaaucagaguaatt

SEQ ID NO: 4111 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucccuaagagucuucccutt

SEQ ID NO: 4112 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agggaagacucuuagggautt

SEQ ID NO: 4113 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccaaaguacaucuuccgtt

SEQ ID NO: 4114 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cggaagauguacuuuggcatt

SEQ ID NO: 4115 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccucggguuuaggggaugtt

SEQ ID NO: 4116 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauccccuaaacccgaggatt

SEQ ID NO: 4117 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcugaaaccucagcaggctt

SEQ ID NO: 4118 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gccugcugagguuucagcatt

SEQ ID NO: 4119 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccacccacgggugugugggtt

SEQ ID NO: 4120 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccacacacccguggguggtt

SEQ ID NO: 4121 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggugcaguaaugacuacctt

SEQ ID NO: 4122 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gguagucauuacugcaccatt

SEQ ID NO: 4123 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucuccaccuagauucuuutt

SEQ ID NO: 4124 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaagaaucuagguggagaatt

SEQ ID NO: 4125 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaaggcgccggcgaucgcgtt

SEQ ID NO: 4126 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgcgaucgccggcgccuuatt

SEQ ID NO: 4127 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggaacuaguaaauuccautt

SEQ ID NO: 4128 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auggaauuuacuaguuccatt

SEQ ID NO: 4129 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggacccugcuggaccccuutt

SEQ ID NO: 4130 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagggguccagcagggucctt

SEQ ID NO: 4131 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaauuauuucacuuaacctt

SEQ ID NO: 4132 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gguuaagugaaauaauugatt

SEQ ID NO: 4133 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccggacaagggcaacgagtt

SEQ ID NO: 4134 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucguugcccuuguccgggtt

SEQ ID NO: 4135 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuaaaacugugaaccggtt

SEQ ID NO: 4136 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccgguucacaguuuuaaaatt

SEQ ID NO: 4137 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugcuucgccgccagcacctt

SEQ ID NO: 4138 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggugcuggcggcgaagcactt

SEQ ID NO: 4139 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggaccccuuccucggguutt

SEQ ID NO: 4140 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacccgaggaagggguccatt

SEQ ID NO: 4141 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuguauauuaaggcgccggtt

SEQ ID NO: 4142 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccggcgccuuaauauacagtt

SEQ ID NO: 4143 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugcccccaccccucaccatt

SEQ ID NO: 4144 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggugaggggugggggcaatt

SEQ ID NO: 4145 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auggggcggugugcccacutt

SEQ ID NO: 4146 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agugggcacaccgccccautt

SEQ ID NO: 4147 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuauaguaaaaacauaguctt

SEQ ID NO: 4148 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacuauguuuuuacuauagtt

SEQ ID NO: 4149 - RNA, 21 nt, Artificial Sequence
  source: /note="Description of Artificial Sequence: Synthetic oligonucleotide"
gaaagagugucucaucuucuu

SEQ ID NO: 4150 - RNA, 23 nt, Artificial Sequence
  source: /note="Description of Artificial Sequence: Synthetic oligonucleotide"
aagaagaugagacacucuuucug

We claim:

1. A method of treating a disorder related to ALAS1 expression, comprising administering to a subject in need of such treatment a therapeutically effective amount of a double-stranded ribonucleic acid (dsRNA), wherein said dsRNA comprises a sense strand and an antisense strand, each of which are 15-30 nucleotides in length, wherein the antisense strand comprises a region of complementarity to an ALAS1 RNA and comprises at least 15 contiguous nucleotides differing by no more than 3 nucleotides from SEQ ID NO: 1296, and wherein the antisense strand is complementary to at least nucleotides 871-889 of SEQ ID NO: 1.

2. A method of treating a porphyria comprising administering to a subject in need of such treatment a double-stranded ribonucleic acid (dsRNA), wherein said dsRNA comprises a sense strand and an antisense strand each of which are 15-30 nucleotides in length, and wherein the antisense strand comprises at least 15 contiguous nucleotides differing by no more than 3 nucleotides from SEQ ID NO: 1296.

3. The method of claim 2, wherein the subject is at risk for developing, or is diagnosed with, a porphyria.

4. The method of claim 3, wherein the dsRNA is administered before, during or after an acute attack of porphyria, or is administered prophylactically to prevent an acute attack of porphyria.

5. The method of claim 2, wherein the dsRNA is in the form of a GalNAc conjugate.

6. The method of claim 2, wherein the dsRNA is administered at a dose of 0.05-50 mg/kg.

7. The method of claim 2, wherein the dsRNA is administered at a concentration of 0.01 mg/kg-5 mg/kg.

8. The method of claim 2, wherein the method decreases a level of a porphyrin or a porphyrin precursor in the subject.

9. The method of claim 8, wherein the porphyrin precursor is 6-aminolevulinic acid (ALA) or porphopilinogen (PBG).

10. The method of claim 2, wherein the dsRNA has an $IC_{50}$ in the range of 0.01-1 nM.

11. The method of claim 2, wherein said method:
  (i) ameliorates a symptom associated with a porphyria,
  (ii) inhibits ALAS1 expression in the subject,
  (iii) decreases a level of a porphyrin precursor or a porphyrin in the subject,
  (iv) decreases frequency of acute attacks of symptoms associated with a porphyria in the subject, or
  (v) decreases incidence of acute attacks of symptoms associated with a porphyria in the subject when the subject is exposed to a precipitating factor.

12. The method of claim 2, wherein the dsRNA comprises modifications on the nucleotides and the modifications are selected from the group consisting of LNA, HNA, CeNA, 2'-methoxyethyl, 2'-O-alkyl, 2'-O-allyl, 2'-C-allyl, 2'-fluoro, 2'-deoxy, 2'-hydroxyl, and combinations thereof.

13. The method of claim 12, wherein the modifications on the nucleotides are 2'-O-methyl, 2'-fluoro or both.

14. The method of claim 2, wherein the dsRNA comprises a carbohydrate ligand.

15. The method of claim 14, wherein the ligand is attached via a linker.

16. The method of claim 15, wherein the linker is a bivalent or trivalent branched linker.

17. The method of claim 14, wherein the ligand is

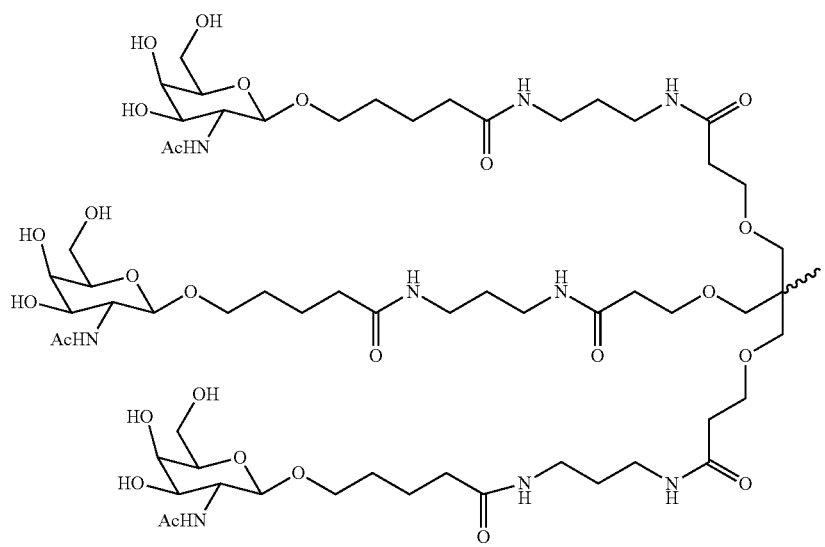 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

18. The method of claim 15, wherein the ligand and linker are as shown in Formula XXIV:

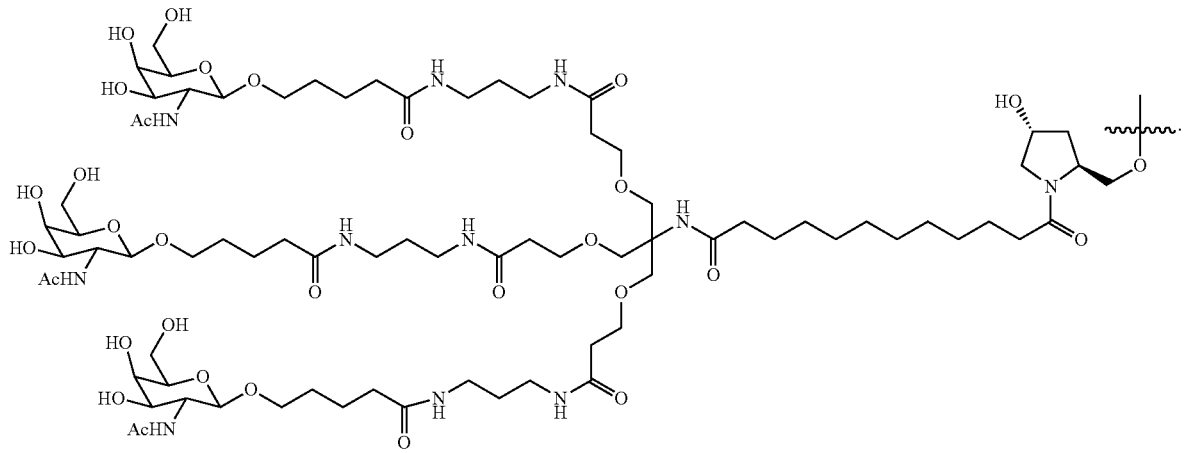 [SMILES: *OC[C@@H]1C[C@@H](O)CN1C(=O)CCCCCCCCCCC(=O)NC(COCCC(=O)NCCCNC(=O)CCCCOC1OC(CO)C(O)C(O)C1NC(C)=O)(COCCC(=O)NCCCNC(=O)CCCCOC1OC(CO)C(O)C(O)C1NC(C)=O)COCCC(=O)NCCCNC(=O)CCCCOC1OC(CO)C(O)C(O)C1NC(C)=O]

19. The method of claim 18, wherein the ligand is attached to the 3' end of the sense strand.

20. The method of claim 2, wherein the porphyria is a hepatic porphyria selected from the group consisting of acute intermittent porphyria (AIP) hereditary coproporphyria (HCP), variegate porphyria (VP), ALA deyhdratase deficiency porphyria (ADP), and hepatoerythropoietic porphyria.

21. The method of claim 2, wherein the dsRNA is administered during a prodrome.

22. The method of claim 2, wherein the subject has an elevated level of ALA, PBG, or both.

23. The method of claim 22, wherein the subject suffers from chronic pain.

24. A method of treating a subject with an elevated level of ALA, PBG, or both ALA and PBG, the method comprising administering to the subject a double-stranded ribonucleic acid (dsRNA), wherein said dsRNA comprises a sense strand and an antisense strand each of which are 15-30 nucleotides in length and the antisense strand comprises at least 15 contiguous nucleotides differing by no more than 3 nucleotides from SEQ ID NO: 1296.

25. The method of claim 24, wherein the method is effective to decrease the level of ALA, PBG, or both ALA and PBG.

26. The method of claim 14, wherein the ligand comprises one or more N-acetylgalactosamine (GalNAc) derivatives.

27. The method of claim 2, wherein the dsRNA comprises one or more phosphorothioate linkages.

28. The method of claim 12, wherein the dsRNA comprises at least 20 modified nucleotides.

29. The method of claim 28, wherein the dsRNA comprises nucleotide modifications on the entire length of the sense and antisense strands.

30. The method of claim 2, wherein the dsRNA comprises at least one blunt end.

31. The method of claim 2, wherein the dsRNA comprises a 3' overhang of at least one nucleotide on the antisense strand or the sense strand.

32. The method of claim 31, wherein the 3' overhang is two nucleotides in length.

33. The method of claim 31, wherein the 3' overhang is present on the 3' ends of both the antisense strand and the sense strand.

34. The method of claim 31, wherein the 3' overhang is present on the antisense strand.

35. The method of claim 34, wherein one or more of the nucleotides in the overhang is a nucleoside thiophosphate.

36. The method of claim 2, wherein the region of complementarity is 19 to 24 nucleotides in length.

37. The method of claim 2, wherein the dsRNA comprises a duplex region that is 17-23 nucleotide pairs in length.

38. The method of claim 2, wherein each strand of the dsRNA is 19-24 nucleotides in length.

39. A method of treating a subject having a porphyria, the method comprising administering to the subject a double-stranded ribonucleic acid (dsRNA), wherein said dsRNA comprises a sense strand and an antisense strand each of which are 19-24 nucleotides in length, wherein (i) the antisense strand comprises at least 15 contiguous nucleotides of SEQ ID NO: 1296,
(ii) the sense strand comprises at least 15 contiguous nucleotides of SEQ ID NO:1295,
(iii) the dsRNA comprises a ligand attached to the 3' end of the sense strand and having the structure

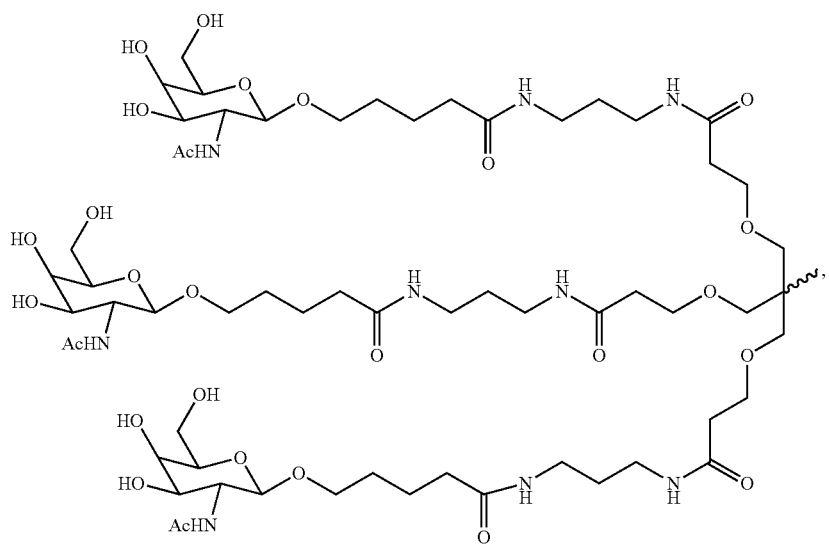 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

(iv) the nucleotides of the dsRNA are modified on the entire length of the sense strand and the antisense strand with 2'-O-methyl and 2'-fluoro modifications, and (v) the antisense strand comprises a 3'-overhang of two nucleotides.

40. The method of claim 39, wherein the dsRNA comprises one or more phosphorothioate linkages.

41. The method of claim 39, wherein the ligand is attached via a linker as shown in Formula XXIV:

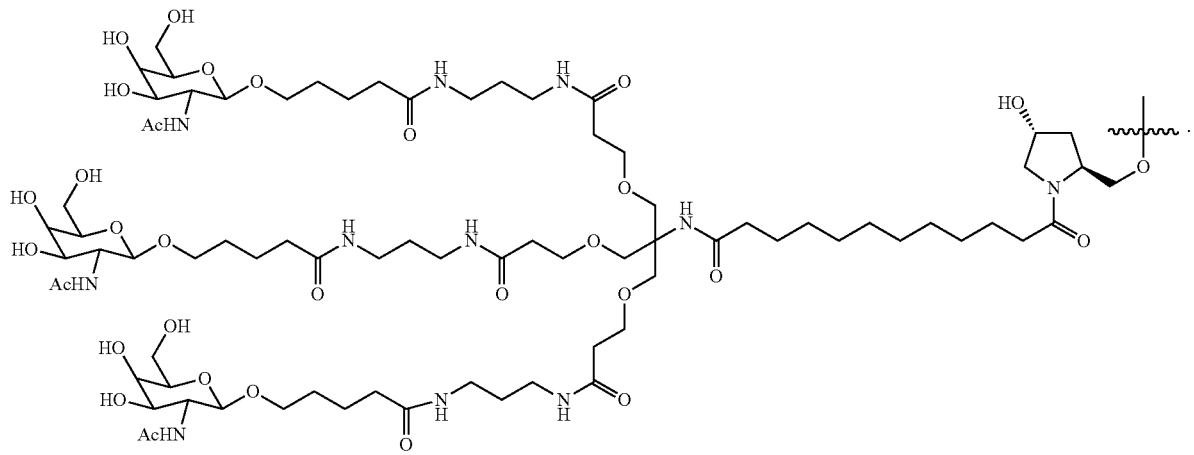 [SMILES: *OC[C@@H]1C[C@@H](O)CN1C(=O)CCCCCCCCCCC(=O)NC(COCCC(=O)NCCCNC(=O)CCCCOC1OC(CO)C(O)C(O)C1NC(C)=O)(COCCC(=O)NCCCNC(=O)CCCCOC1OC(CO)C(O)C(O)C1NC(C)=O)COCCC(=O)NCCCNC(=O)CCCCOC1OC(CO)C(O)C(O)C1NC(C)=O]

42. The method of claim 2, wherein the sense strand comprises at least 15 contiguous nucleotides of SEQ ID NO: 1295.

43. The method of claim 2, wherein the antisense strand is complementary to at least nucleotides 871-889 of SEQ ID NO: 1.

44. The method of claim 24, wherein the antisense strand is complementary to at least nucleotides 871-889 of SEQ ID NO: 1.

45. The method of claim 39, wherein the antisense strand is complementary to at least nucleotides 871-889 of SEQ ID NO: 1.

* * * * *